United States Patent
Lian et al.

(10) Patent No.: US 12,428,627 B2
(45) Date of Patent: Sep. 30, 2025

(54) MUTANT P-HYDROXYPHENYLPYRUVATE DIOXYGENASE, AND CODING NUCLEIC ACID AND USE THEREOF

(71) Applicant: Qingdao Kingagroot Chemical Compound Co., Ltd., Qingdao (CN)

(72) Inventors: Lei Lian, Qingdao (CN); Sudong Mo, Qingdao (CN); Huarong Li, Qingdao (CN); Guangdi Yuan, Qingdao (CN); Zhenguo Li, Qingdao (CN); Junjie Zhang, Qingdao (CN); Dehui Ding, Qingdao (CN); Bo Chen, Qingdao (CN); Guizhi Liu, Qingdao (CN); Chao Song, Qingdao (CN); Lei Wang, Qingdao (CN)

(73) Assignee: Qingdao Kingagroot Chemical Compound Co., Ltd., Qingdao (CN)

( * ) Notice: Subject to any disclaimer, the term of this patent is extended or adjusted under 35 U.S.C. 154(b) by 1081 days.

(21) Appl. No.: 15/734,623

(22) PCT Filed: May 31, 2019

(86) PCT No.: PCT/CN2019/089512
§ 371 (c)(1),
(2) Date: Dec. 3, 2020

(87) PCT Pub. No.: WO2019/233349
PCT Pub. Date: Dec. 12, 2019

(65) Prior Publication Data
US 2021/0230563 A1     Jul. 29, 2021

(30) Foreign Application Priority Data

Jun. 4, 2018  (CN) .................. 201810565916.X
Jan. 28, 2019  (CN) .................. 201910077823.7

(51) Int. Cl.
  *C12N 9/02*     (2006.01)
  *C12N 15/82*    (2006.01)

(52) U.S. Cl.
  CPC ....... *C12N 9/0069* (2013.01); *C12N 15/8274* (2013.01); *C12Y 113/11027* (2013.01)

(58) Field of Classification Search
  CPC .............. C12N 9/0069; C12N 15/8274; C12Y 113/11027
  See application file for complete search history.

(56) References Cited

U.S. PATENT DOCUMENTS

| | | |
|---|---|---|
| 2004/0058427 A1 | 3/2004 | Andrews et al. |
| 2005/0246800 A1 | 11/2005 | Dunne et al. |
| 2017/0058291 A1 | 3/2017 | Siehl et al. |

FOREIGN PATENT DOCUMENTS

| | | |
|---|---|---|
| CN | 1285875 A | 2/2001 |
| CN | 101573355 A | 11/2009 |
| CN | 105368799 A | 3/2016 |
| CN | 105595163 A | 5/2016 |
| CN | 106070244 A | 11/2016 |
| CN | 108866092 A | 11/2018 |
| EP | 2669370 A1 | 12/2013 |
| RU | 2014135403 A | 3/2016 |
| WO | WO 98/20144 | 5/1998 |
| WO | WO 02/46387 A2 | 6/2002 |
| WO | WO 2011145015 A1 | 11/2011 |
| WO | WO 2012/021785 A1 | 2/2012 |
| WO | WO 2013064964 A1 | 5/2013 |
| WO | WO-2014177991 A2 * | 11/2014 ........... A01N 43/653 |
| WO | WO 2015/168667 A2 | 11/2015 |
| WO | WO 2017028768 A1 | 2/2017 |
| WO | WO 2017/217794 A1 | 12/2017 |

OTHER PUBLICATIONS

Huang et al., The Toxic Effects of Thirty-Six Typical Herbicides on Green Algae Growth, *Asian Journal of Ecotoxicology*, Aug. 31, 2017, No. 4, 193-201, vol. 12, 2017.
Wang et al., Synthesis and Bioactivity Studies of Triketone-Containing Quinazolin-2, 4-dione Derivatives, *Acta Chimica Sinica*, 73(1): 29-35, Jan. 31, 2015.
Datebase UniProtKB, I1NXM0 (I1NXM0_ORYGL), https://www.uniprot.org/uniprotkb/I1NXM0/.
Jinek et al., A programmable dual-RNA-guided DNA endonuclease in adaptive bacterial immunity. *Science.* 337: 816-821 (2012).
Cong et al., Multiplex genome engineering using CRISPR/Cas systems. *Science.* 339: 819-823 (2013).
Li et al., Multiplex and homologous recombination-mediated genome editing in *Arabidopsis* and Nicotiana benthamiana using guide RNA and Cas9. *Nat. Biotechnol.* 31: 688 (2013).
Mali et al., RNA-guided human genome engineering via Cas9. *Science.* 339: 823 (2013).
Zhang et al., Genome Editing-Principles and Applications for Functional Genomics Research and Crop Improvement, *Critical Reviews in Plant Sciences*, 36:4, 291-309 (2017).

(Continued)

*Primary Examiner* — Paul J Holland
(74) *Attorney, Agent, or Firm* — FINNEGAN, HENDERSON, FARABOW, GARRETT & DUNNER LLP

(57) ABSTRACT

The present invention relates to a mutant p-hydroxyphenylpyruvate dioxygenase (HPPD) protein or a bioactive fragment thereof and an isolated polynucleotide comprising a nucleic acid sequence encoding the protein or fragment thereof, wherein the mutant p-hydroxyphenylpyruvate dioxygenase (HPPD) protein or a bioactive fragment thereof retains or enhances the property of catalyzing the conversion of p-hydroxyphenylpyruvate (HPP) to homogentisate and is significantly less sensitive to HPPD-inhibiting herbicides than a wild-type HPPD. The present invention also relates to a nucleic acid construct, an expression vector and a host cell comprising the polynucleotide, as well as to a method for producing a plant that has the property of catalyzing the conversion of p-hydroxyphenylpyruvate (HPP) to homogentisate and significantly reduced sensitivity to HPPD-inhibiting herbicides.

6 Claims, 12 Drawing Sheets

Specification includes a Sequence Listing.

(56) References Cited

OTHER PUBLICATIONS

Komor et al., Programmable editing of a target base in genomic DNA without double-stranded DNA cleavage. *Nature.* 533(7603):420-4 (2016).
Gaudelli et al., Programmable base editing of A•T to G•C in genomic DNA without DNA cleavage. *Nature.* 551(7681): 464-471 (2017).
Yan et al., High-efficient A•T to G•C base editing by Cas9n-guided tRNA adenosine deaminase in rice. *Mol. Plant.* 11:631-634 (2018).
Zetsche et al., Cpf1 is a single RNA-guided endonuclease of a Class 2 CRISPR Cas system. *Cell.* 163: 759-771 (2015).
Endo et al., Efficient targeted mutagenesis of rice and tobacco genomes usingCpf1 from Francisella novicida. *Sci. Rep.* 6: 38169 (2016).
Kim et al., CRISPR/Cpf1-mediated DNA-free plant genome editing. *Nat. Commun.* 8: 14406 (2017).
Tang et al., A CRISPR-Cpf1 system for efficient genome editing and transcriptional repression in plants. *Nat. Plants.* 3: 17018 (2017).
Wang et al., Multiplex gene editing in rice using the CRISPR-Cpf1 system. *Mol. Plant.* 10: 1011-1013 (2017).
Sun et al., Engineering Herbicide-Resistant Rice Plants through CRISPR/Cas9-Mediated Homologous Recombination of Acetolactate Synthase. *Molecular Plant* 9,628-631 (2016).
Chen et al., CRISPR/Cas9-mediated base-editing system efficiently generates gain-of-function mutations in Arabidopsis. *Sci China Life Sci* 60:520-523 (2017).
Siehl et al., Broad 4-Hydroxyphenylpyruvate Dioxygenase Inhibitor Herbicide Tolerance in Soybean with an Optimized Enzyme and Expression Cassette. *Plant Physiol.* 166(3): 1162-1176 (2014).
Kille et al., Reducing codon redundancy and screening effort of combinatorial protein libraries created by saturation mutagenesis. *ACS Synth Biol* 2(2):83-92 (2013).
Ding et al., Validation of a rice specific gene, sucrose phosphate synthase, used as the endogenous reference gene for qualitative and real-time quantitative PCR detection of transgenes [J]. *J. Agric. Food Chem.*, 52: 3372-7 (2004).
Hsu et al., DNA targeting specificity of RNA-guided Cas9 nucleases, *Nat Biotechnol.* 31(9):827-32 (2013).
International Search Report for International Application No. PCT/CN2019/089512, dated Oct. 25, 2019.
Written Opinion for International Application No. PCT/CN2019/089512, dated Oct. 25, 2019.
Wing et al., 4-hydroxyphenylpyruvate dioxygenase—oryza glaberrima, *Database UniProt* [*Online*], xp055892553, Database accession No. I1NXM0.
Costa et al., Fusion tags for protein solubility, purification and immunogenicity in *Escherichia coli*: the novel Fh8 system, *Frontiers in Microbiology*, Feb. 1, 2014, pp. 1-20, vol. 5.
Supplementary Partial European Search Report dated Mar. 23, 2022.
Genbank Database Accession No. XP_015626163, "4-hydroxyphenylpyruvate dioxygenase [Oryza sativa Japonica Group]", National Center for Biotechnology Information (NCBI), U.S. National Library of Medicine; PLN Aug. 7, 2018 (2 pages).

* cited by examiner

Donor DNA
1796 bp

A: Homologously replaced rice seedlings

B: HPPD G342D (GGC>GAC), D370N (GAC>AAC) Sequences of targeted sites

MUTANT P-HYDROXYPHENYLPYRUVATE DIOXYGENASE, AND CODING NUCLEIC ACID AND USE THEREOF

CROSS-REFERENCE TO RELATED APPLICATIONS

This application is a national stage filing under 35 U.S.C. § 371 of International Application No. PCT/CN2019/089512, filed May 31, 2019, and claims the priority to and benefits of Chinese Patent Application No. 201810565916.X, filed Jun. 4, 2018, and Chinese Patent Application No. 201910077823.7, filed Jan. 28, 2019, which are incorporated herein by reference in their entireties.

TECHNICAL FIELD

The present invention belongs to the field of agricultural genetic engineering, and in particular relates to a novel mutant p-hydroxyphenylpyruvate dioxygenase (HPPD), which confers plants with resistance or tolerance to HPPD-inhibiting herbicides, a nucleic acid encoding the same and use thereof.

BACKGROUND OF THE INVENTION

P-hydroxyphenylpyruvate dioxygenases (HPPD) are enzymes which catalyze the reaction in which hydroxyphenylpyruvate (HPP) is converted into homogentisate. This reaction takes place in the presence of enzyme-bound iron and oxygen. Herbicides which function by inhibiting HPPD are well known and include various types, such as isoxazoles, diketonitriles, triketones and pyrazoline salts. Inhibition of HPPD blocks the biosynthesis of plastoquinone (PQ) from tyrosine. PQ is an essential cofactor in the biosynthesis of carotenoid pigments, which are necessary for photoprotection of photosynthetic center. Herbicides that inhibit HPPD are bleaches that can move through the phloem, which cause new meristems and leaves exposed to light to appear white. In the absence of carotenoids, chlorophyll is photo-destructible and it itself becomes a photochemical cleavage agent by the photosensitization of singlet oxygen.

Technical routes and methods for providing plants that are tolerant to HPPD-inhibiting herbicides are also known, including overexpressing the HPPD enzyme so as to produce quantities of the HPPD enzyme in the plant which are fully relevant to a given herbicide so that the plant has enough functional enzyme available despite the presence of its inhibitor, or mutating the target HPPD enzyme into a functional HPPD which is less sensitive to the herbicide. HPPD-inhibiting herbicides are a large class that covers many different types. While a given HPPD enzyme may provide a useful level of tolerance to some HPPD-inhibiting herbicides it may be quite inadequate to provide commercial levels of tolerance to a different, more desirable HPPD-inhibiting herbicide (see, for example, US Application Publication No. 2004/0058427; and PCT Application Publication No. WO 98/20144 and WO 02/46387; see also U.S. Application Publication No. 2005/0246800, which relates to the identification and labeling of soybean varieties that are relatively resistant to HPPD). Moreover, different HPPD-inhibiting herbicides can differ in terms of the range of weeds they control, the applied crop objects, manufacturing costs and environmental benefits from each. Hence, there is still a need in the art for a novel mutant HPPDs that for confer resistance/tolerance to HPPD-inhibiting herbicides to different crops and crop varieties.

Transgenic technique has been widely used in the creation of herbicide-tolerant crops and crop varieties. However, the use of transgenic crops has been limited due to high registration costs, and this situation can be altered due to advances in gene editing techniques among which CRISPR/Cas9 is representative. The CRISPR/Cas9 is a new site-directed gene editing technique having emerged since 2012 (Jinek, M., Chylinski, K., Fonfara, I., Hauer, M., Doudna, J. A., and Charpentier, E. 2012. A programmable dual-RNA-guided DNA endonuclease in adaptive bacterial immunity. Science. 337: 816-821; Cong, L., Ran, F. A., Cox, D., Lin, S., Barretto, R., Habib, N., Hsu, P. D., VMS, X., Jiang, W, Marraffini, L. A., and Zhang, F. 2013. Multiplex genome engineering using CRISPR/Cas systems. Science. 339: 819-823; Li, J. F., Norville, J. E., Aach, J., Mccormack, M., Zhang, D., Bush, J., Church, G. M., and Sheen, J. 2013. Multiplex and homologous recombination-mediated genome editing in *Arabidopsis* and *Nicotiana benthamiana* using guide RNA and Cas9. Nat. Biotechnol. 31: 688; *Mali*, P., Yang, L., Esvelt, K. M., Aach, J., Guell, M., Dicarlo, J. E., Norville, J. E., and Church, G. M. 2013. RNA-guided human genome engineering via Cas9. Science. 339: 823.). The recognition of an edited target by the CRISPR/Cas9 system relies on base pairing between nucleic acid molecules. The system can edit any 20 bp target sequence immediately adjacent PAM (NGG). In addition, the CRISPR/Cas9 system is simple to operate, and it only needs to replace 20-30 bp target nucleotide sequence in an original vector for each targeting, which is suitable for high-throughput operation. Multiple sites of same gene as well as multiple different genes can be edited simultaneously by the system. At present, this technique has exhibited great prospects for use in biomedicines, functional genomics, improvement on traits and creation of new traits in animals and plants, and it has a revolutionary role in facilitating animal and plant breeding (Hui Zhang, Jinshan Zhang, Zhaobo Lang, Jose Ramon Botellad, and Jian-Kang Zhu. 2017. Genome Editing-Principles and Applications for Functional Genomics Research and Crop Improvement, Critical Reviews in Plant Sciences, 36:4, 291-309, DOI: 10.1080/07352689.2017. 1402989).

As a third-generation gene editing tool, CRISPR/Cas9 realizes site-directed editing in three main ways. First, site-directed gene knockout to obtain mutants. Specifically, Cas9 recognizes and cleaves target sites under the direction of guide RNA (gRNA) to generate double-stranded DNA breaks. The DNA breaks are usually repaired by non-homologous end joining (NHEJ), and frameshift mutations easily occur during the process of repair, resulting in destruction of the gene. The efficiency of site-directed gene knockout is high. Second, homologous replacement of a target to replace the target sequence or achieve site-directed insertion. In the case where double-stranded DNA breaks are generated, if a homologous repair template is present in the vicinity, homologous replacement or site-directed insertion may occur. The efficiency of homologous replacement is less and becomes much less as the length of a sequence to be replaced increases. Third, the third approach is base editing (Komor A C, Kim Y B, Packer M S, Zuris J A, Liu D R. Programmable editing of a target base in genomic DNA without double-stranded DNA cleavage. Nature. 2016 May 19: 533(7603):420-4. doi: 10.1038/nature17946; Gaudelli N M, Komor A C, Rees H A, Packer M S, Badran A H, Bryson D I, Liu D R. Programmable base editing of A•T to G•C in genomic DNA without DNA cleavage. Nature. 2017 Nov. 23; 551(7681): 464-471. doi: 10.1038/nature 24644. Epub 2017 Oct. 25. Erratum in: Nature. 2018 May 2). Base editing is a gene editing method that utilizes the CRISPR/Cas9 system to target deaminase to a specific site in genome to modify a specific base. This method has been successfully applied in rice. For example, Yan F., Kuang Y., Ren B., Wang J., Zhang D., Lin H., Yang B., Zhou X., and Zhou H. (2018). High-efficient A-T to G-C base editing by Cas9n-guided tRNA adenosine deaminase in rice. Mol. Plant. doi: 10.1016r.molp. 2018.02.008.

Moreover, CRISPR/Cpf1 can also be used for gene editing (Zetsche, B., Gootenberg, J. S., Abudayyeh, O. O., Slaymaker, I. M., Makarova, K. S., Essletzbichler, P., Volz, S. E., Joung, J., Oost, J., Regev, A., Koonin, E. V., and Zhang, F. 2015. Cpf1 is a single RNA-guided endonuclease of a Class 2 CRISPR Cas system. Cell. 163: 759-771; Endo, A., Masafumi, M., Kaya, H., and Toki, S. 2016a. Efficient targeted mutagenesis of rice and tobacco genomes using Cpf1 from *Francisella novicida*. Sci. Rep. 6: 38169.). CRISPR/Cpf1 contain two main components, the Cpf1 enzyme and the crRNA which determines the specificity of the system. Although the CRISPR/Cpf1 system is similar to CRISPR/Cas9 system, there are certain important differences between them (Hui Zhang, Jinshan Zhang, Zhaobo Lang, Jose Ramón Botella & Jian-Kang Zhu (2017) Genome Editing—Principles and Applications for Functional Genomics Research and Crop Improvement, Critical Reviews in Plant Sciences, 36:4, 291-309, DOI:10.1080/07352689.2017.1402989). First, the CRISPR/Cpf1 system does not need a trans-acting crRNA (tracrRNA), which is necessary for the CRSIPR/Cas9 system. Second, the CRISPR/Cpf1 system is relatively short and only has 42-44 nucleotides comprising a repeat with 19 nucleotides and a spacer with 23-25 nucleotides. Third, unlike Cas9 which cleaves a DNA double strand at the same position (3-4 bp upstream of the PAM) to produce a blunt end, Cpf1 cleaves a target sequence at 23 bp downstream of the PAM sequence and a non-target single strand at 18 bp downstream of the PAM sequence to produce a sticky end with a 5-bp overhang. The resulting sticky end can increase the efficiency of HDR-mediated insertion of donor DNA into the cleavage sites of Cpf1. Fourth, only one promoter is required by the CRISPR/Cpf1 system to drive multiple arrays of small crRNAs when editing multiple targets or genes, making it ideal for multi-target editing. Fifth, the CRISPR/Cas9 system requires a G-rich (5'-NGG-3') PAM sequence at the 3' end of a target sequence, while CRISPR/Cpf1 requires a T rich (5'-TTTN-3' or 5'-TTN-3') PAM sequence at the 5' end of a target sequence and is suitable for editing multiple A/T DNAs or genes. Currently, three engineered CRISPR/Cpf1 systems have been developed, including FnCpf1 from *Francisella novicida*, AsCpf1 from Acidaminococcus sp. and LbCpf1 from Lachnospiraceae bacterium. All three Cpf1 systems have been used for plant genome editing in several species, including rice, *Arabidopsis*, tobacco, and soybean (Endo, A., Masafumi, M., Kaya, H., and Toki, S. 2016a. Efficient targeted mutagenesis of rice and tobacco genomes using Cpf1 from *Francisella novicida*. Sci. Rep. 6: 38169; Kim, H., Kim, S. T., Ryu, J., Kang, B. C., Kim, J. S., and Kim, S. G. 2017. CRISPR/Cpf1-mediated DNA free plant genome editing. Nat. Commun. 8: 14406; Tang, X., Lowder, L. G., Zhang, T., Malzahn, A. A., Zheng, X., Voytas, D. F., Zhong, Z., Chen, Y., Ren, Q., and Li, Q. 2017. A CRISPR-Cpf1 system for efficient genome editing and transcriptional repression in plants. Nat. Plants. 3: 17018; Wang, M., Mao, Y., Lu, Y., Tao, X., and Zhu, J. K. 2017a. Multiplex gene editing in rice using the CRISPR-Cpf1 system. Mol. Plant. 10: 1011-1013).

At present, one of research focus in the field of gene editing is how to improve the tolerance of important crops to herbicides by gene editing-mediated homologous replacement, site-directed modification or single-base editing, wherein several successful examples have been reported, however, most of them focus on tolerance to acetolactate synthase (ALS)-inhibiting herbicides (Yongwei Sun, Xin Zhang, Chuanyin Wu, Ubing He, Youzhi Ma, Han Hou, Xiuping Guo, Wenming Du, Yunde Zhao and Lanqin Xia. 2016. Engineering Herbicide-Resistant Rice Plants through CRISPR/Cas9-Mediated Homologous Recombination of Acetolactate Synthase. Molecular Plant 9,628-631 doi.org/10.1016r.molp.2016.01.001; Yiyu Chen, Zhiping Wang, Hanwen Ni, Yong Xu, Qijun Chen, Linjian Jiang. 2017. CRISPR/Cas9-mediated base-editing system efficiently generates gain-of-function mutations in *Arabidopsis*. Sci China Life Sci 60. doi: 10.1007/s11427-017-9021-5) and to glyphosate herbicides (WO2017028768A1). Accordingly, there is a need that scientists have to continue research and develop new approaches to improve the tolerance of crops to different types of herbicides.

SUMMARY OF THE INVENTION

In view of this, the present invention provides a mutant p-hydroxyphenylpyruvate dioxygenase (HPPD), which confers plants with resistance or tolerance to HPPD-inhibiting herbicides, said mutant HPPD retains or enhances the property of catalyzing the conversion of p-hydroxyphenylpyruvate (HPP) to homogentisate and is significantly less sensitive to HPPD-inhibiting herbicides than a wild-type HPPD. The present invention also relates to a bioactive fragment of the mutant p-hydroxyphenylpyruvate dioxygenase, a polynucleotide encoding the protein or a fragment thereof, and to use thereof.

Accordingly, in one aspect, the present invention provides a mutant p-hydroxyphenylpyruvate dioxygenase (HPPD) protein, which has one or more of mutations selected from the group consisting of 93S, 103S, 141R, 141 K, 141 T, 165V, 191I, 220K, 226H, 276W, 277N, 336D, 337A, 338D, 338S, 338Y, 342D, 346C, 346D, 346H, 346S, 346Y, 370N, 377C, 386T, 390I, 392L, 403G, 410I, 418P, 419F, 419L, 419V, 420S, 420T, 430G, and 431 L at one or more positions corresponding to positions 93, 103, 141, 165, 191, 220, 226, 276, 277, 336, 337, 338, 342, 346, 370, 377, 386, 390, 392, 403, 410, 418, 419, 420, 430 and 431 of the amino acid sequence of wild-type rice p-hydroxyphenylpyruvate dioxygenase protein as set forth in SEQ ID NO: 2. Preferably, the amino acid sequence of the mutant p-hydroxyphenylpyruvate dioxygenase protein further has at least 80%, at least 85%, at least 90%, at least 95%, at least 96%, at least 97%, at least 98% or at least 99% sequence identity to the amino acid sequence as set forth in SEQ ID NO: 2. More preferably, the mutant p-hydroxyphenylpyruvate dioxygenase protein has the amino acid sequence as set forth in SEQ ID NO: 2, except that it has one or more amino acid mutations selected from the group consisting of 93S, 103S, 141R, 141 K, 141 T, 165V, 191I, 220K, 226H, 276W, 277N, 336D, 337A, 338D, 338S, 338Y, 342D, 346C, 346D, 346H, 346S, 346Y, 370N, 377C, 386T, 390I, 392L, 403G, 410I, 418P, 419F, 419L, 419V, 420S, 420T, 430G, and 431 L at one or more positions corresponding to positions 93, 103, 141, 165, 191, 220, 226, 276, 277, 336, 337, 338, 342, 346, 370, 377, 386, 390, 392, 403, 410, 418, 419, 420, 430 and 431 of the amino acid sequence of wild-type rice p-hydroxyphenylpyruvate dioxygenase protein as set forth in SEQ ID NO: 2.

In another aspect, the present invention provides a bioactive fragment of the mutant p-hydroxyphenylpyruvate dioxygenase (HPPD) protein, which fragment lacks a moiety of one or more (for example, 1-50, 1-25, 1-10 or 1-5, e.g., 1, 2, 3, 4 or 5) of amino acid residues at the N- and/or C-terminus of the protein, but still retains the desired biological activity of the full-length protein, that is, the fragment retains or enhances the property of catalyzing the conversion of p-hydroxyphenylpyruvate (HPP) to homogentisate and is significantly less sensitive to HPPD-inhibiting herbicides than a wild-type HPPD or a corresponding bioactive fragment thereof.

The present invention further relates to a fusion protein comprising the mutant p-hydroxyphenylpyruvate dioxygenase (HPPD) protein or a bioactive fragment thereof according to the present invention and an additional component that is fused thereto, for example, a peptide or polypeptide component. Preferably, the component endows the fusion protein with desired properties, for example, facilitating its isolation and purification, increasing its stability, extending its half-life, providing additional biological activity, and directing the fused HPPD protein into a target region, such as a plastid e.g., chloroplasts. The options for the corresponding component are well known to a person skilled in the art.

In another aspect, the present invention provides an isolated polynucleotide comprising a nucleic acid sequence encoding the mutant p-hydroxyphenylpyruvate dioxygenase (HPPD) protein or a bioactive fragment thereof or the fusion protein.

The present invention further provides a nucleic acid construct comprising the polynucleotide and a regulatory element operably linked thereto.

In a further aspect, the present invention provides an expression vector comprising the polynucleotide and an expression regulatory element operably linked thereto.

In yet another aspect, the invention provides a host cell comprising the polynucleotide, nucleic acid construct or expression vector.

The present invention further provides a method of producing a plant having an improved resistance or tolerance to HPPD-inhibiting herbicides.

The present invention further relates to a plant produced by the above method.

The present invention also provides a method of improving the resistance or tolerance of a plant to HPPD-inhibiting herbicides, comprising expressing the mutant p-hydroxyphenylpyruvate dioxygenase (HPPD) protein or a bioactive fragment thereof or the fusion protein according to the present invention in the plant.

The present invention further provides a method of improving the resistance or tolerance of a plant to HPPD-inhibiting herbicides, comprising crossing a plant expressing the mutant p-hydroxyphenylpyruvate dioxygenase (HPPD) protein or a bioactive fragment thereof or the fusion protein according to the present invention with another plant.

The present invention further provides a method of improving the resistance or tolerance of a plant to HPPD-inhibiting herbicides, comprising gene editing an endogenous HPPD protein gene of the plant cell, plant tissue, plant part or plant.

The present invention further relates to use of the mutant p-hydroxyphenylpyruvate dioxygenase (HPPD) protein or a bioactive fragment thereof or the fusion protein according to the present invention for improving the resistance or tolerance of a plant to HPPD-inhibiting herbicides.

The present invention further relates to a method for controlling weeds in a plant cultivation site, comprising applying to a site comprising the plant or seed according to the present invention a herbicidally effective amount of one or more HPPD-inhibiting herbicide, without significantly affecting the plant.

DESCRIPTION OF FIGURES

FIG. 1 shows the color reaction of a culture medium of a recombinant *E. coli* transformed with a wild-type or mutant rice HPPD gene cultured in a 96-well plate, wherein the recombinant *E. coli* expresses the wild-type rice HPPD (WT) or one of single-site mutant rice HPPDs, and the recombinant *E. coli* is cultured in a culture medium containing a herbicide, tembotrione (left) or a metabolic product of benzuofucaotong (right, having a structural formula of

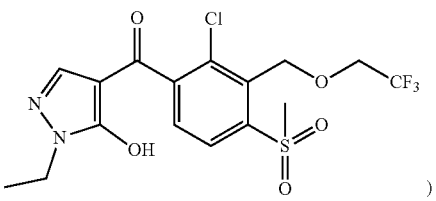 [SMILES: CCn1ncc(C(=O)c2ccc(S(C)(=O)=O)c(COCC(F)(F)F)c2Cl)c1O]

)

at different concentrations, displaying different degrees of color change. In wells with the herbicide at same concentration, the darker the color, the higher the resistance/tolerance to this herbicide.

Figure 2:
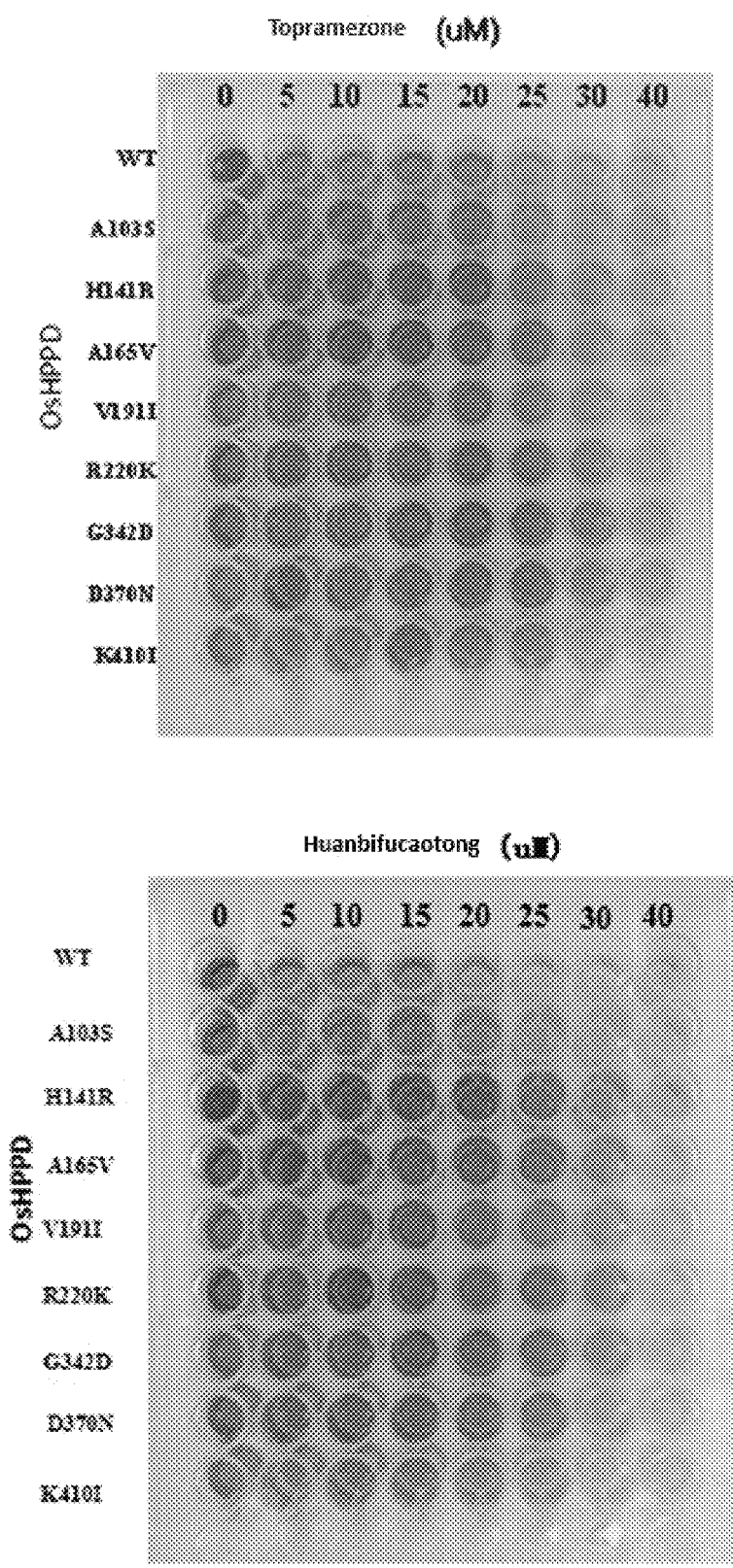

FIG. 2 shows the color reaction of a culture medium of a recombinant *E. coli* transformed with a wild-type or mutant rice HPPD gene cultured in a 96-well plate, wherein the recombinant *E. coli* expresses the wild-type rice HPPD (WT) or each of single-site mutant rice HPPDs, and the recombinant *E. coli* is cultured in a culture medium containing a herbicide, huanbifucaotong (left) or topramezone (right) at different concentrations, displaying different degrees of color change. In wells with the herbicide at same concentration, the darker the color, the higher the resistance/tolerance to this herbicide.

Figure 3:
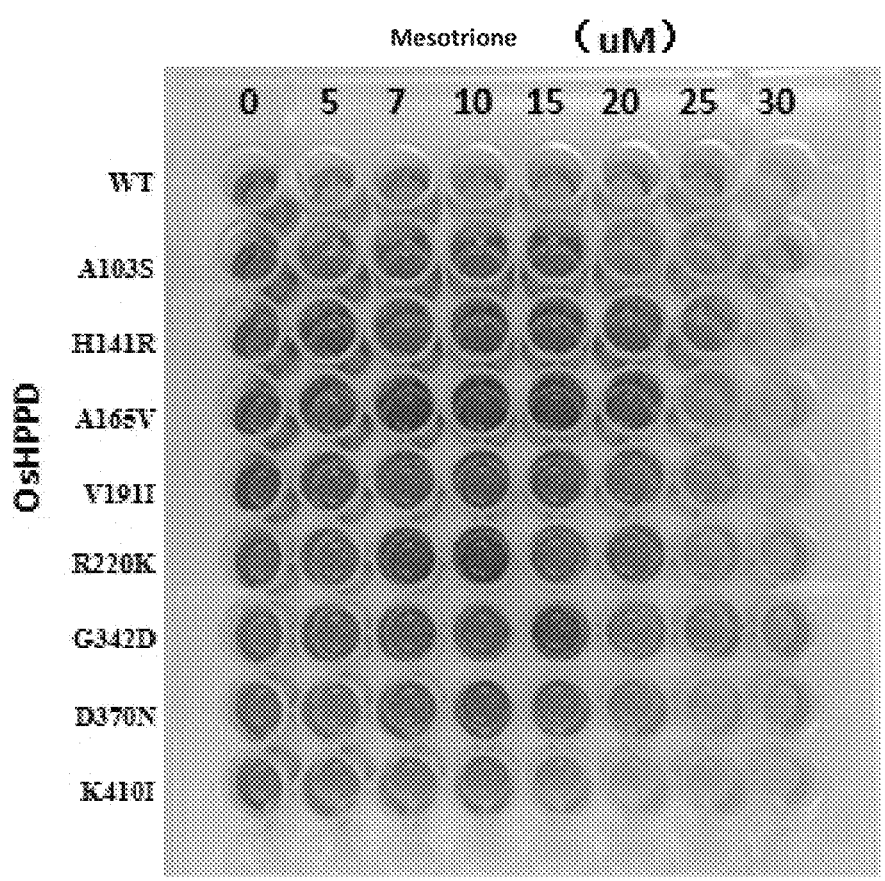

FIG. 3 shows the color reaction of a culture medium of a recombinant *E. coli* transformed with a wild-type or mutant rice HPPD gene cultured in a 96-well plate, wherein the recombinant *E. coli* expresses the wild-type rice HPPD (WT) or each of single-site mutant rice HPPDs, and the recombinant *E. coli* is cultured in a culture medium containing a herbicide mesotrione at different concentrations, displaying different degrees of color reaction. In wells with the herbicide at same concentration, the darker the color, the higher the resistance/tolerance to this herbicide.

Figure 4:
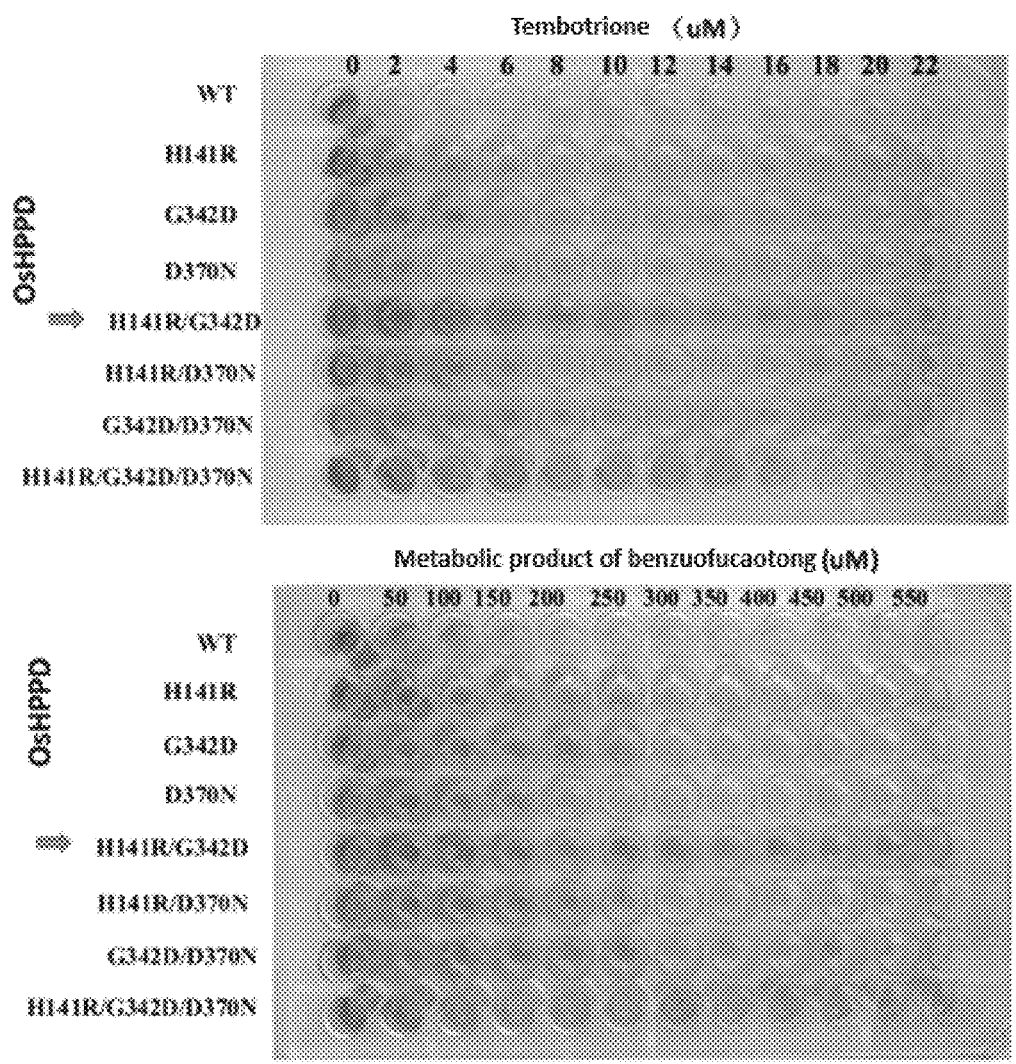

FIG. 4 shows the color reaction of a culture medium of a recombinant *E. coli* transformed with a wild-type or mutant rice HPPD gene cultured in a 96 well plate, wherein the recombinant *E. coli* expresses the wild-type rice HPPD (WT) or a single-site mutant HPPD comprising a mutation of H141R, G342D or D370N or a combination thereof, and the recombinant E. co/i is cultured in a culture medium containing a herbicide, tembotrione (above) or a metabolic product of benzuofucaotong (below), at different concentrations, displaying different degrees of color change. In wells with the herbicide at same concentration, the darker the color, the higher the resistance/tolerance to this herbicide.

Figure 5:
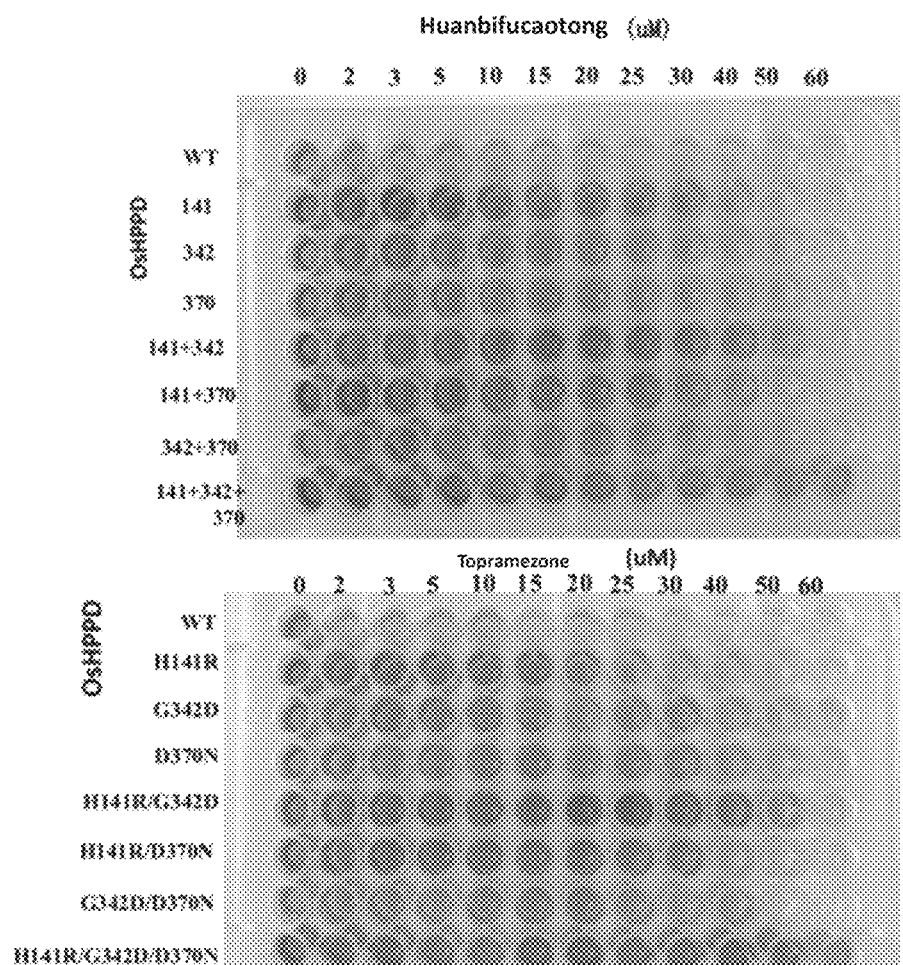

FIG. 5 shows the color reaction of a culture medium of a recombinant *E. coli* transformed with a wild-type or mutant rice HPPD gene cultured in a 96-well plate, wherein the recombinant E. co/i expresses the wild-type rice HPPD (WT) or a single-site mutant HPPD comprising a mutation of H141R, G342D or D370N or a combination thereof (wherein 141+342 represents H141R/G342D; 141+370 represents H141R/D370N; 342+370 represents G342D/D370D; and 141+342+370 represents H141R/G342D/D370N), and the recombinant E. coli is cultured in a culture medium containing a herbicide, huanbifucaotong (above) or a metabolic product of topramezone (below), at different concentrations, displaying different degrees of color change. In wells with the herbicide at same concentration, the darker the color, the higher the resistance/tolerance to this herbicide.

Figure 6:
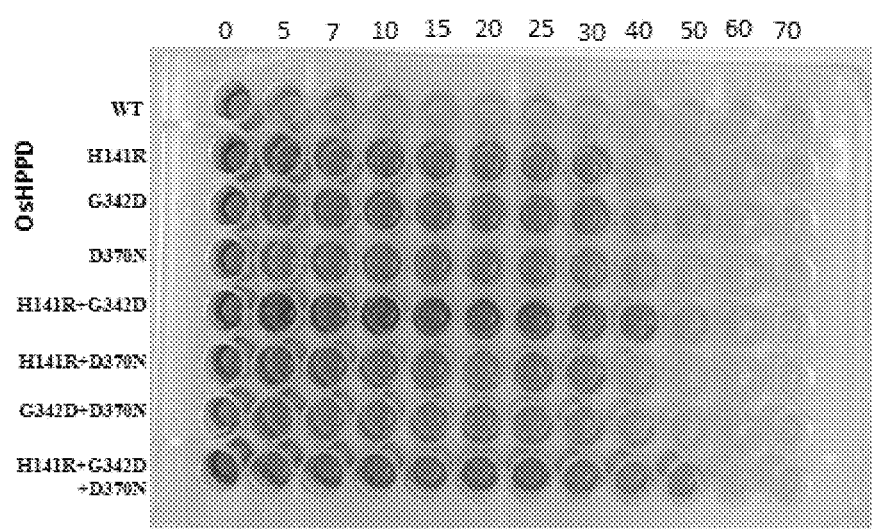

FIG. 6 shows the color reaction of a culture medium of a recombinant E. coli transformed with a wild-type or mutant rice HPPD gene cultured in a 96 well plate, wherein the recombinant E. coli expresses the wild-type rice HPPD (WT) or a single-site mutant HPPD comprising a mutation of H141R, G342D or D370N or a combination thereof in the culture medium, and the recombinant E. coli is cultured in a culture medium containing a herbicide, mesotrione, at different concentrations, displaying different degrees of color change. In wells with the herbicide at same concentration, the darker the color, the higher the resistance/tolerance to this herbicide.

Figure 7:
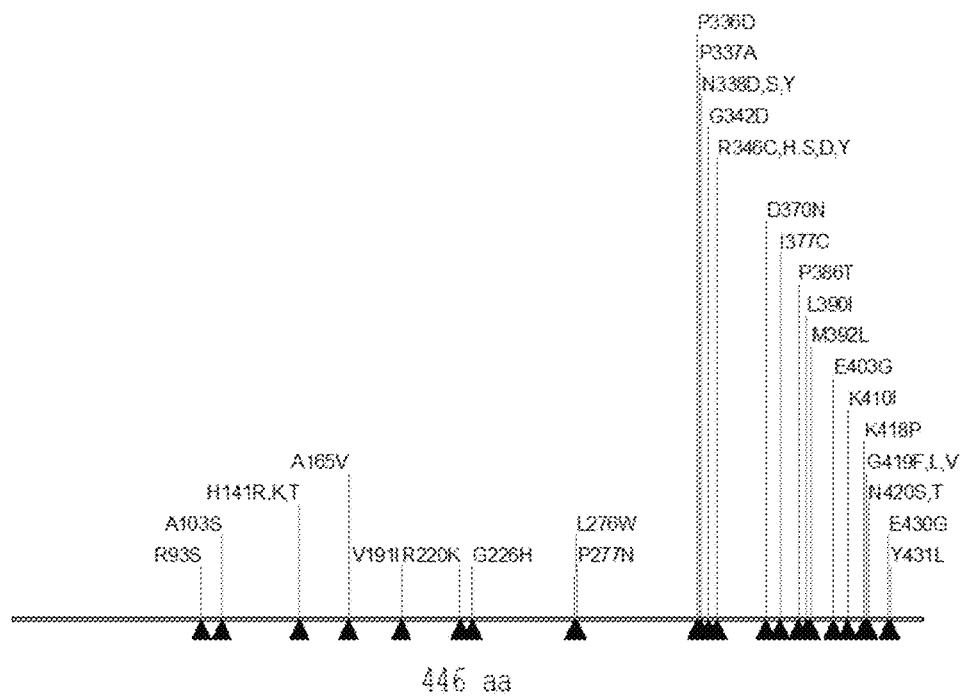

FIG. 7 shows all amino acid mutations noted on the wild-type rice HPPD protein.

Figure 8:
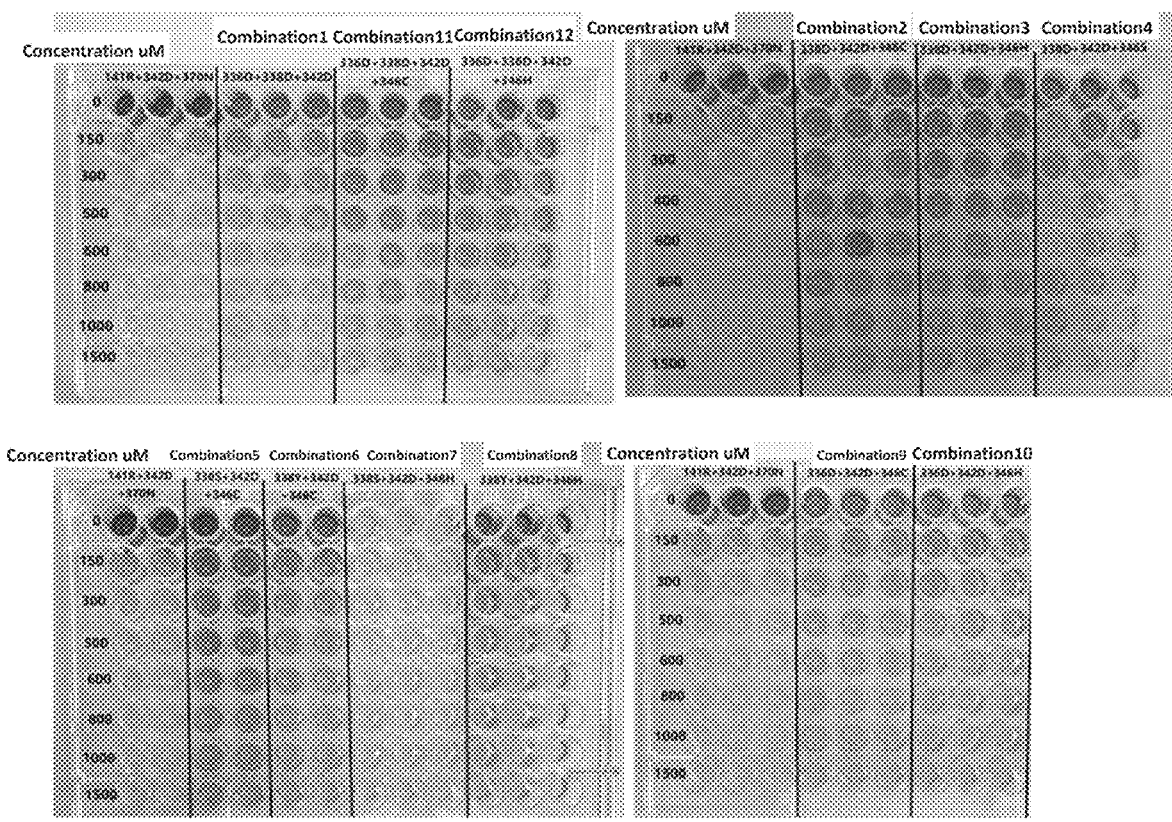

FIG. 8 shows the color reaction of a culture medium of a recombinant E. coli transformed with a mutant rice HPPD gene cultured in a 96 well plate, wherein the recombinant E. coli expresses a mutant HPPD comprising various combination of mutations at close positions 336-338-342-346 and the combination of 141R+342D+370N (wherein the 336D, 338D, 338S, 338Y, 342D, 346C, 346H and 346S represent P336D, N338D, N338S, N338Y, G342D, R346C, R346H and R346S, respectively; 141R+342D+370N represents H141R/G342D/D370N) in the culture medium, and the recombinant E. coli is cultured in a culture medium containing a herbicide, a metabolic product of shuangzuocaotong (with a code number of 101, having a structural formula of

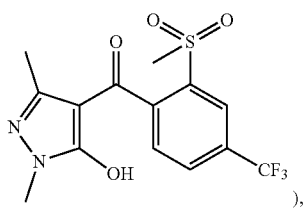 [SMILES: Cc1nn(C)c(O)c1C(=O)c1ccc(C(F)(F)F)cc1S(C)(=O)=O]

), at different concentrations, displaying different degrees of color change. In wells with the herbicide at same concentration, the darker the color, the higher the resistance/tolerance to this herbicide.

Figure 9:
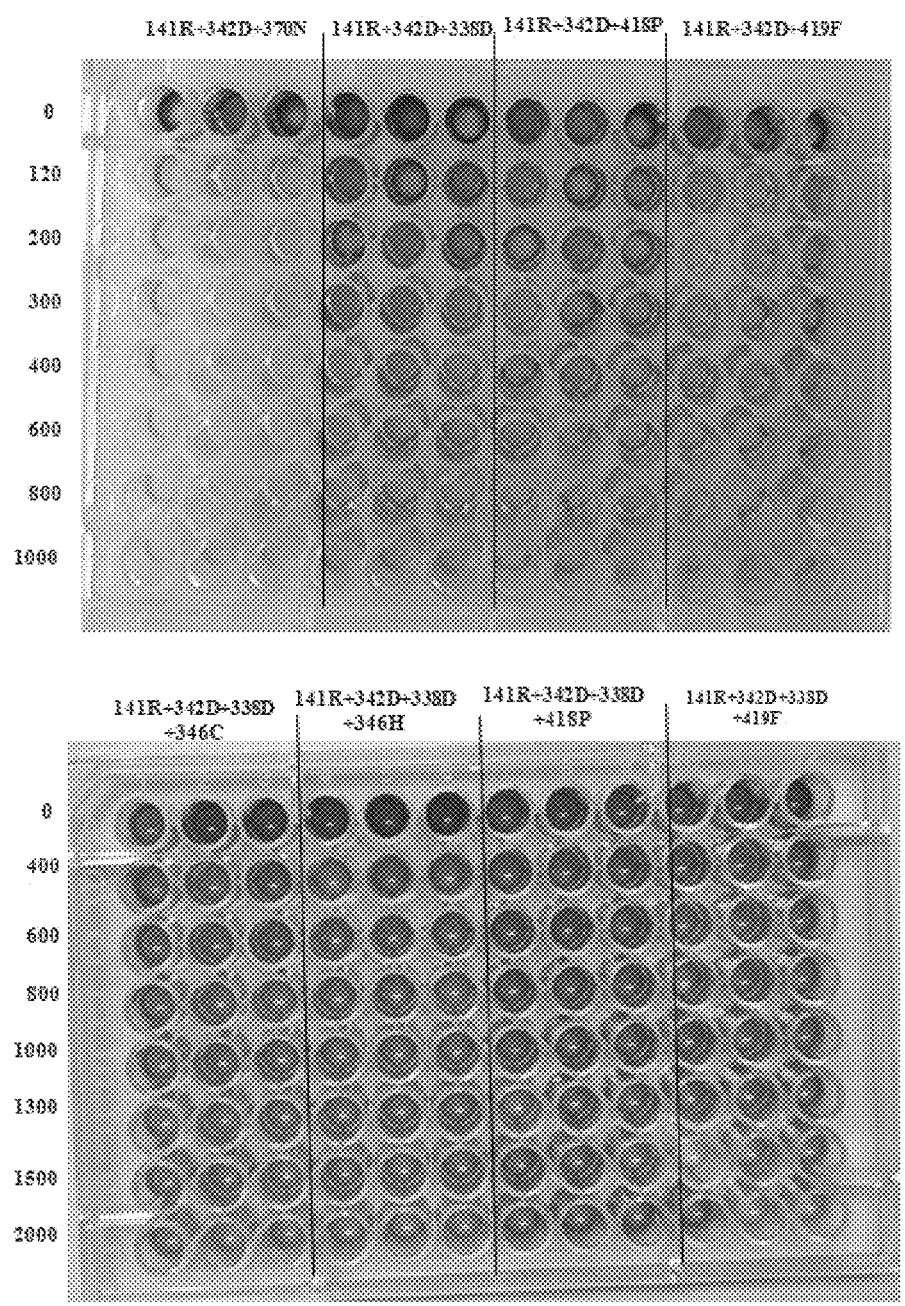

FIG. 9 shows the color reaction of a culture medium of a recombinant E. coli transformed with a mutant rice HPPD gene cultured in a 96 well plate, wherein the recombinant E. coli expresses a mutant HPPD comprising various combination of mutations at 3 or 4 positions (wherein the 141R, 336D, 338D, 338S, 338Y, 342D, 346C, 346S, 346H, 370N, 418P and 419F represent H141R, P336D, N338D, N338S, N338Y, G342D, R346C, R346S, R346H, D370N, K418P and G419F, respectively) in the culture medium, and the recombinant E. coli is cultured in a culture medium containing a herbicide, a metabolic product of shuangzuocaotong, at different concentrations, displaying different degrees of color change. In wells with the herbicide at same concentration, the darker the color, the higher the resistance/tolerance to this herbicide.

Figure 10:
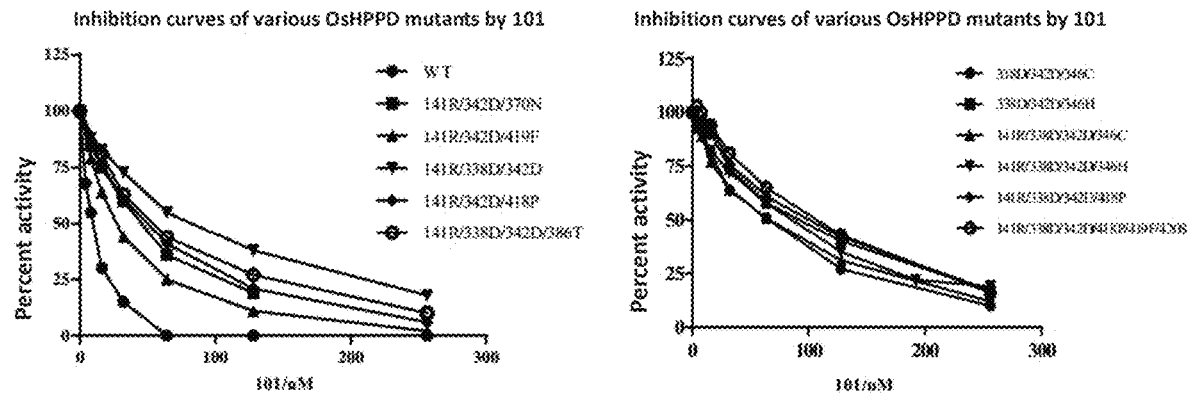

FIG. 10 shows the curves concerning the inhibition of the OsHPPD WT and various mutants by the metabolic product of shuangzuocaotong, wherein the abscissa indicates the concentration of the compound 101, the ordinate indicates the residual activity of enzyme at different concentrations of the compound 101 in which the reaction rate is of 100% at the concentration of the inhibitor of 0, and the numbers in the figure represent the various mutation sites. It can be seen from the figure that the wild-type WT is extremely sensitive to the compound 101, and the activity is completely inhibited at a concentration of about 60 μM of the compound 101, and each mutant shows a strongly enhanced resistance. Based on the results, the $IC_{50}$ value expressing the inhibition of activity of each mutant by the compound 101 can be calculated, similarly confirming that each mutant shows significantly improved resistance relative to the wild-type OsHPPD (wherein 141R, 338D, 342D, 346C, 346H, 370N, 386T, 418P, 419F, and 420S represent H141R, N338D, G342D, R346C, R346H, D370N, P386T, K418P, G419F, and N420S, respectively).

Figure 11:
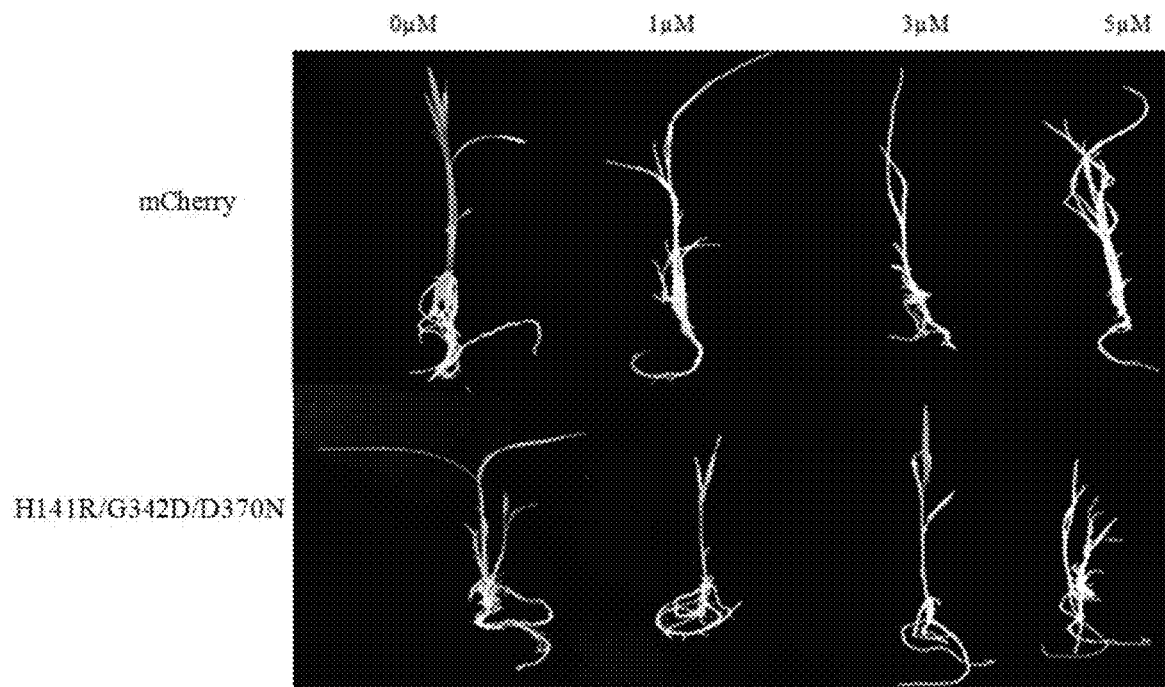

FIG. 11 shows the sensitivity of transgenic rice (Zhonghua 11) to the HPPD-inhibiting herbicide, tembotrione. The rice expressing mutant OsHPPD3M (H141R/G342D/D370N) is able to remain green in a culture medium containing 3 μM of tembotrione, but the seedling expressing mCherry as a negative control (CK) is also severely whitened in a culture medium of 1.0 μM of tembotrione (phytotoxicity).

Figure 12:
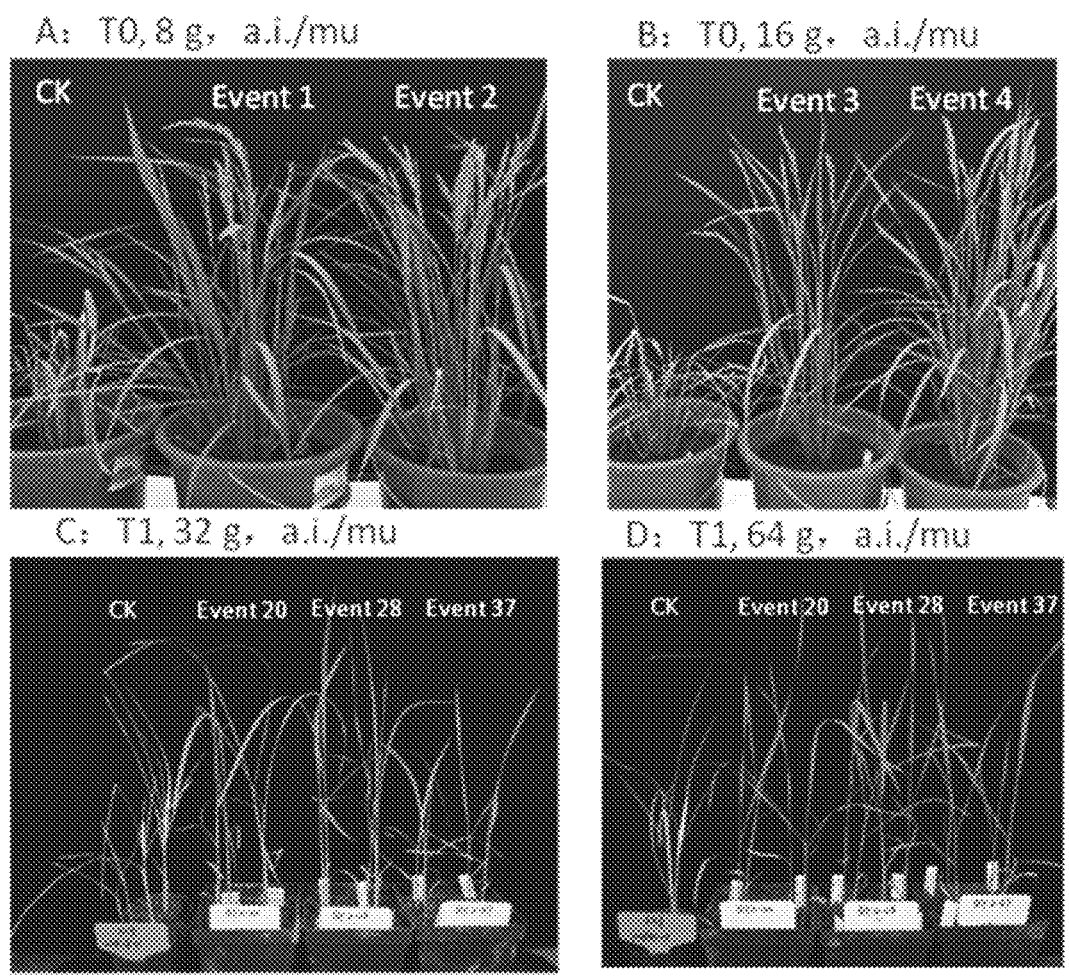

FIG. 12 shows the tolerance of transgenic rice (Zhonghua 11) to the HPPD-inhibiting herbicide, shuangzuocaotong. TO generation plants expressing the rice mutant OsHPPD3M are tolerant to 8-16 grams of shuangzuocaotong as an active ingredient per mu, but the non-transgenic controls (CK) die soon after severe whitening (A, B); T1 generation plants expressing the rice mutant OsHPPD3M are tolerant to 32-64 grams of shuangzuocaotong as an active ingredient per mu, but the non-transgenic controls die soon after severe whitening (C, D).

Figure 13:
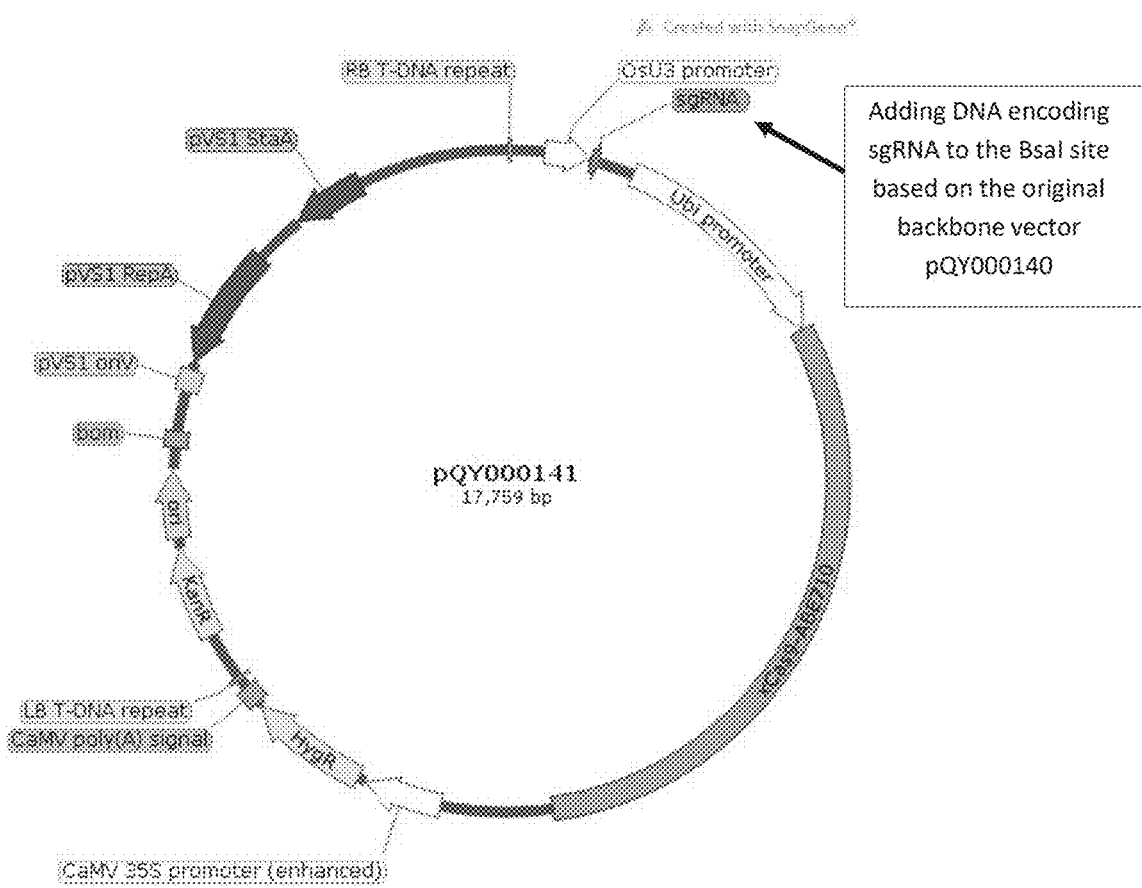

FIG. 13 shows a base-editing vector of rice HPPD gene.

Figure 14:
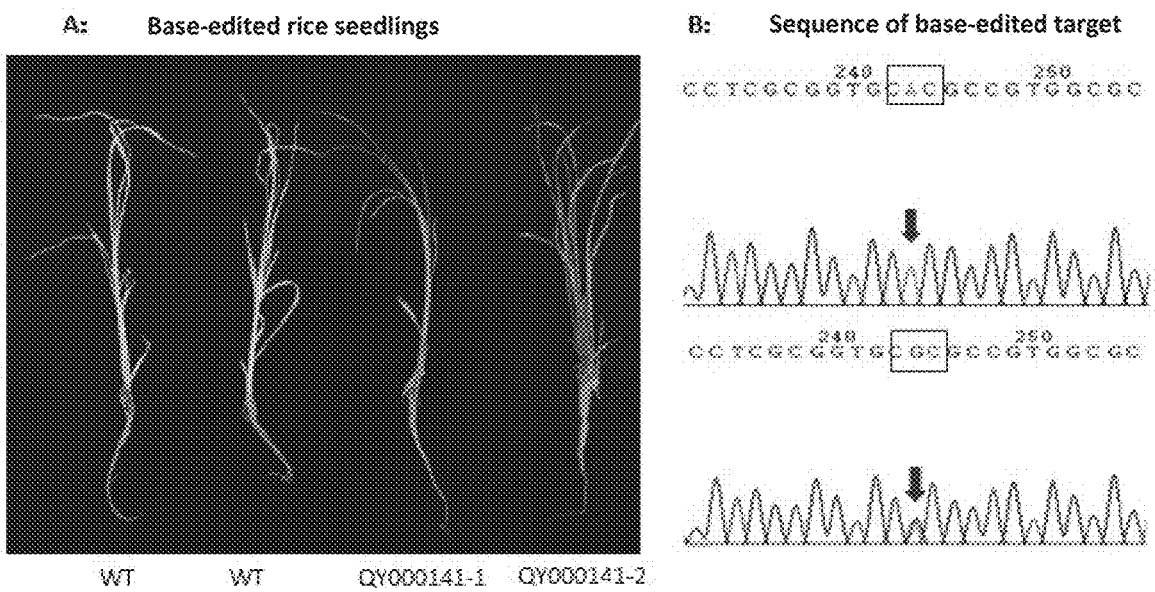

FIG. 14 shows a base-edited rice seedling and sequence analysis of the target H141R (CAC>CGC) thereof.

A: the base-edited seedlings: in the culture medium containing 0.4 μM of tembotrione, the unsuccessfully edited seedlings are whitened (phytotoxicity), and the successfully edited ones remain green.

B: the sequence of the base-edited target: the amino acid at the position 141 of the wild-type rice HPPD is histidine (His), and the corresponding codon is CAC (the above panel), while, after editing, the corresponding amino acid is arginine (Arg), and the corresponding codon is CGC (the example is a hybrid, and there is a double peak).

Figure 15:
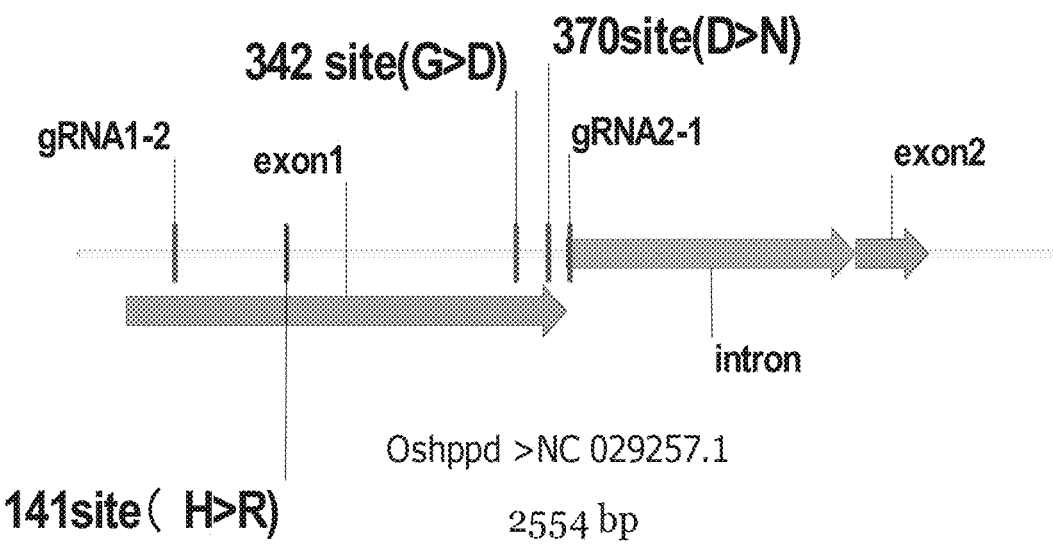

FIG. 15 shows the structure of the rice hppd gene (Oshppd>NCO29257.1), displaying two exons, one intron, three mutation sites (141, 342, 370) and designed targeting cleavage sites (gRNA1-2, gRNA2-1).

Figure 16:
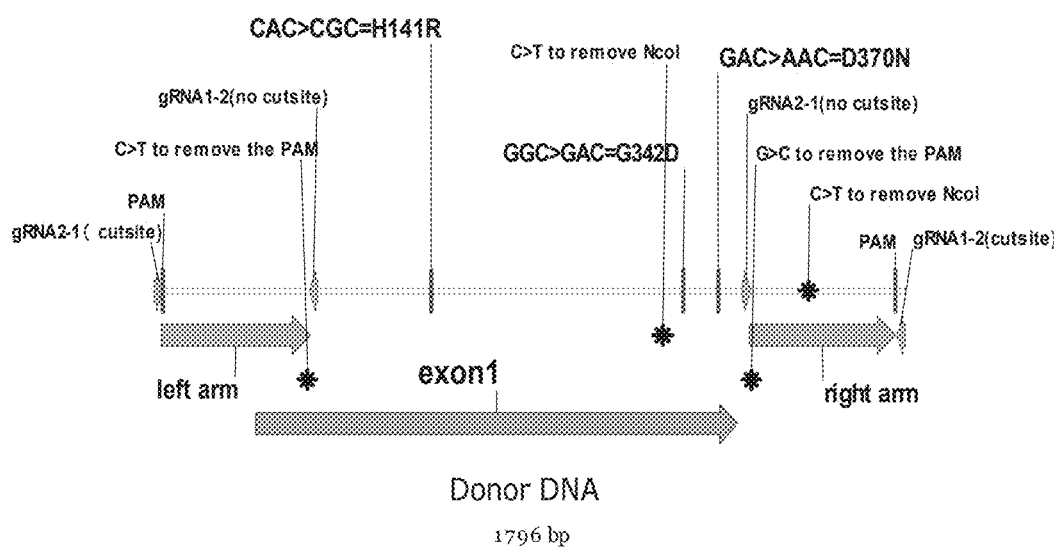

FIG. 16 shows the structure of the template DNA, wherein the length of the core replacement region for the three mutated amino acids 141-342-370 is 1056 bp, the left and right homology arms each are in length of 350 bp, 6 bp is left at each of the left and right ends after cleavage from the vector, and the total length of the template is 1768 bp; in order to facilitate rapid genotyping of PCR product after PCR amplification, the NcoI cleavage site is removed; and in order to avoid re-cleavage after replacement, the PAM (NGG) at the original cleavage site in the template is also removed.

Figure 17:
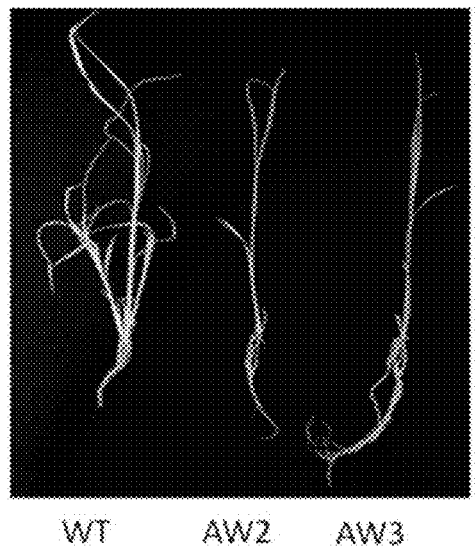
Figure 17:
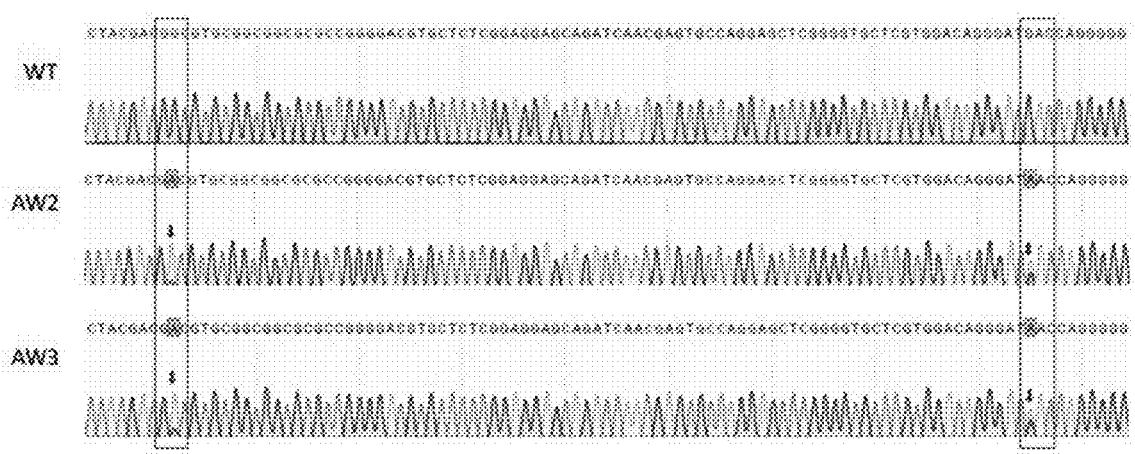

FIG. 17 shows the homologously substituted three mutation sites (H141R-G342D-D370N) of the rice HPPD gene.

A: the rice HPPD gene-edited seedlings: in the culture medium containing 0.4 µM of tembotrione, the unsuccessfully edited seedlings (wild-type WT) are whitened (phytotoxicity), and the successfully edited ones (two seedlings: AW2 and AW3) remain green;

B: after the homologous replacement, the codons corresponding to the amino acid positions 342 and 370 change, i.e., GGC becomes GAC and GAC becomes AAC (a hybrid: leading to partial G342D and D370N); H141R (CAC>CGC) is also successfully edited (the sequence is not listed in the figure).

DETAILED DESCRIPTION OF THE INVENTION

Some terms used in the specification are defined as follows.

In the present invention, the term "HPPD-inhibiting herbicide" refers to a substance that has herbicidal activity per se or a substance that is used in combination with other herbicides and/or additives which can change its effect, and the substance can act by inhibiting HPPD. Substances which are capable of producing herbicidal activity by inhibiting HPPD are well known in the art, including many types: 1) triketones, e.g., sulcotrione (CAS No.: 99105-77-8), mesotrione (CAS No.: 104206-82-8), bicyclopyrone (CAS No.: 352010-68-5), tembotrione (CAS No.: 335104-84-2), tefuryltrione (CAS No.: 473278-76-1), benzobicyclon (CAS No.: 156963-66-5); 2) diketonitriles, e.g., 2-cyano-3-cyclopropyl-1-(2-methylsulfonyl-4-trifluoromethylphenyl)propane-1,3-dione (CAS No.: 143701-75-1), 2-cyano-3-cyclopropyl-1-(2-methylsulfonyl-3,4-dichlorophenyl)propane-1,3-dione (CAS No.: 212829-55-5), 2-cyano-1-[4-(methylsulfonyl)-2-trifluoromethylphenyl]-3-(1-methylcycloprop-yl)propane-1,3-dione (CAS No.: 143659-52-3): 3) isoxazoles, e.g., isoxaflutole (CAS No.: 141112-29-0); isoxachlortole (CAS No.: 141112-06-3), clomazone (CAS No.: 81777-89-1); 4) pyrazoles, e.g., topramezone (CAS No.: 210631-68-8); pyrasulfotole (CAS No.: 365400-11-9), pyrazoxyfen (CAS No.: 71561-11-0); pyrazolate (CAS No.: 58011-68-0), benzofenap (CAS No.: 82692-44-2), shuangzuocaotong (CAS No.: 1622908-18-2), tolpyralate (CAS No.: 1101132-67-5), benzuofucaotong (CAS No.: 1992017-55-6), huanbifucaotong (CAS No.: 1855929-45-1), sanzuohuangcaotong (CAS No.: 1911613-97-2); 5) benzophenons; 6) others: lancotrione (CAS No.: 1486617-21-3), fenquinotrione (CAS No.: 1342891-70-6). Preferably, the said herbicides are tembotrione, benzuofucaotong, huanbifucaotong, topramezone, mesotrione, shuangzuocaotong or any combinations thereof and the like.

Plants having "enhanced tolerance to HPPD-inhibiting herbicides" or "enhanced resistance to HPPD-inhibiting herbicides" refer to such plants that have higher tolerance or resistance to the said HPPD-inhibiting herbicides as compared to plants with wild type HPPD genes. HPPD enzymes having "enhanced tolerance to HPPD-inhibiting herbicides" or "enhanced resistance to HPPD-inhibiting herbicides" refer to such HPPD enzymes that exhibit an enzyme activity that is at least 10%, preferably at least 15%, more preferably at least 20%, higher than wild-type HPPD enzymes at herbicide concentrations known to inhibit the activity of the corresponding wild-type HPPD enzyme protein. In the present invention, the terms "HPPD-inhibiting herbicide tolerance" and "HPPD-inhibiting herbicide resistance" are used interchangeably and the both refer to tolerance to HPPD-inhibiting herbicides and resistance to HPPD-inhibiting herbicides.

The term "wild type" refers to an existing nucleic acid molecule or protein that can be found in nature.

The terms "protein", "polypeptide" and "peptide" can be used interchangeably in the present invention and refer to a polymer of amino acid residues, including polymers of chemical analogs in which one or more amino acid residues are natural amino acid residues. The proteins and polypeptides of the present invention may be recombinantly produced or chemically synthesized. The term "mutated protein" or "mutant protein" refers to a protein having substitutions, insertions, deletions and/or additions of one or more amino acid residues as compared to the amino acid sequence of a corresponding wild-type protein.

The terms "polynucleotide" and "nucleic acid" are used interchangeably, including DNA, RNA or hybrids thereof, which are either double-stranded or single-stranded.

In the present invention, the "host organism" should be understood to mean any single or multicellular organism into which a nucleic acid encoding a mutant HPPD protein can be introduced, including, for example, bacteria such as *Escherichia coli*, fungi such as yeast (e.g., *Saccharomyces cerevisiae*), molds (e.g., *aspergillus*), plant cells, plants and the like.

In the present invention, the "plant" should be understood to mean any differentiated multicellular organism capable of performing photosynthesis, in particular monocotyledonous or dicotyledonous plants, for example, (1) food crops: *Oryza* spp., like *Oryza sativa, Oryza latifolia, Oryza sativa, Oryza glaberrima; Triticum* spp., like *Triticum aestivum, T. Turgidumssp. durum; Hordeum* spp., like *Hordeum vulgare, Hordeum arizonicum; Secale cereale; Avena* spp., like *Avena sativa, Avena fatua, Avena byzantine, Avena fatua var.sativa, Avena hybrida; Echinochloa* spp., like *Pennisetum glaucum, Sorghum, Sorghum bicolor, Sorghum vulgare*, Triticale, *Zea mays* or Maize, Millet, Rice, Foxtail millet, Proso millet, *Sorghum bicolor, Panicum, Fagopyrum* spp., *Panicum miliaceum, Setaria italica, Zizania palustris, Eragrostis tef, Panicum miliaceum, Eleusine coracana*; (2) legume crops: Glycine spp. like *Glycine max, Soja hispida, Soja max, Vicia* spp., *Vigna* spp., *Pisum* spp., field bean, *Lupinus* spp., *Vicia, Tamarindus indica, Lens culinaris, Lathyrus* spp., Lablab, broad bean, mung bean, red bean, chickpea; (3) oil crops: *Arachis hypogaea, Arachis* spp, *Sesamum* spp., *Helianthus* spp. like *Helianthus annuus, Elaeis* like *Eiaeis guineensis, Elaeis* oleifera, soybean, Brassicanapus, *Brassica oleracea, Sesamum orientale, Brassica juncea*, Oilseed rape, Camellia oleifera, oil palm, olive, castor-oil plant, *Brassica napus* L., canola; (4) fiber crops: Agave sisalana, *Gossypium* spp. like *Gossypium, Gossypium barbadense, Gossypium hirsutum, Hibiscus cannabinus*, Agave sisalana, *Musa textilis* Nee, *Linum usitatissimum, Corchorus capsularis* L, Boehmeria *nivea* (L.), *Cannabis sativa, Cannabis sativa*; (5) fruit crops: *Ziziphus* spp., *Cucumis* spp., *Passiflora edulis, Vitis* spp., *Vaccinium* spp., *Pyrus communis, Prunus* spp., *Psidium* spp., *Punica granatum, Malus* spp., *Citrullus lanatus, Citrus* spp., *Ficus carica, Fortunella* spp., *Fragaria* spp., *Crataegus* spp., *Diospyros* spp., *Eugenia unifora, Eriobotrya japonica, Dimocarpus longan, Carica papaya, Cocos* spp., *Averrhoa carambola, Actinidia* spp., *Prunus amygdalus, Musa* spp. (*musa acuminate*), *Persea* spp. (*Persea *Americana*), *Psidium guajava, Mammea Americana, Mangifera indica, Canarium* album (Oleaeuropaea), Caricapapaya, *Cocos nucifera, Malpighia emarginata, Manilkara zapota, Ananas comosus, Annona* spp., *Citrus reticulate* (*Citrus* spp.), *Artocarpus* spp., *Litchi chinensis, Ribes* spp., *Rubus* spp., pear, peach, apricot, plum, red bayberry, lemon, kumquat, durian, orange, strawberry, blueberry, hami melon, muskmelon, date palm, walnut tree, cherry tree; (6) rhizome crops: *Manihot* spp., *Ipomoea batatas, Colocasia esculenta*, tuber mustard, *Allium cepa* (onion), *eleocharis* tuberose (water chestnut), *Cyperus rotundus, Rhizoma dioscoreae*; (7) vegetable crops: *Spinacia* spp., *Phaseolus* spp., *Lactuca sativa, Momordica* spp, *Petroselinum crispum, Capsicum* spp., *Solanum* spp. (such as *Solanum tuberosum, Solanum integrifolium, Solanum lycopersicum*), *Lycopersicon* spp. (such as *Lycopersicon esculentum, Lycopersicon lycopersicum, Lycopersicon pyriforme*), Macrotyloma spp., Kale, *Luffa acutangula*, lentil, okra, onion, potato, artichoke, asparagus, broccoli, Brussels sprouts, cabbage, carrot, cauliflower, celery, collard greens, squash, *Benincasa hispida, Asparagus officinalis, Apium graveolens, Amaranthus* spp., *Allium* spp., *Abelmoschus* spp., *Cichorium endivia, Cucurbita* spp., *Coriandrum sativum, B. carinata, Rapbanus sativus, Brassica* spp. (such as *Brassica napus, Brassica rapa* ssp., canola, oilseed rape, turnip rape, turnip rape, leaf mustard, cabbage, black mustard, canola (rapeseed), Brussels sprout, Solanaceae (eggplant), *Capsicum annuum* (sweet pepper), cucumber, luffa, Chinese cabbage, rape, cabbage, calabash, Chinese chives, lotus, lotus root, lettuce; (8) flower crops: *Tropaeolum minus, Tropaeolum majus, Canna indica,* Opuntia spp., *Tagetes* spp., Cymbidium (orchid), *Crinum asiaticum* L., *Clivia, Hippeastrum rutilum, Rosa rugosa, Rosa Chinensis, Jasminum sambac, Tulipa gesneriana* L., *Cerasus* sp., *Pharbitis* nil (L.) Choisy, *Calendula officinalis* L., *Nelumbo* sp., *Bellis perennis* L., *Dianthus caryophyllus, Petunia hybrida, Tulipa gesneriana* L., *Lilium* brownie, *Prunus* mume, *Narcissus* tazetta L., *Jasminum nudiflorum* Lindl., *Primula malacoides, Daphne odora, Camellia japonica, Michelia alba, Magnolia liliiflora, Viburnum macrocephalum, Clivia miniata, Malus spectabilis, Paeonia suffruticosa, Paeonia lactiflora, Syzygium aromaticum, Rhododendron simsii, Rhododendron hybridum, Michelia figo* (Lour.) Spreng., *Cercis chinensis, Kerria japonica, Weigela florida, Fructus forsythiae, Jasminum mesnyi, Parochetus communis, Cyclamen persicum* Mill., *Phalaenophsis* hybrid, *Dendrobium nobile, Hyacinthus orientalis, Iris tectorum* Maxim, *Zantedeschia aethiopica, Calendula officinalis, Hippeastrum rutilum, Begonia semperflorenshybr, Fuchsia hybrida, Begonia* maculataRaddi, Geranium; (9) medicinal crops: Carthamus tinctorius, *Mentha* spp., *Rheum rhabarbarum, Crocus sativus, Lycium chinense, Polygonatum odoratum, Polygonatum* Kingianum, Anemarrhena asphodeloides Bunge, Radix ophiopogonis, *Fritillaria cirrhosa, Curcuma aromatica, Amomum villosum* Lour., *Polygonum multiflorum, Rheum officinale, Glycyrrhiza uralensis* Fisch, *Astragalus membranaceus, Panax ginseng, Panax notoginseng, Acanthopanax gracilistylus, Angelica sinensis, Ligusticum wallichii,* Bupleurum sinenses DC., *Datura stramonium* Linn., *Datura metel* L., *Mentha haplocalyx, Leonurus sibiricus* L., *Agastache rugosus, Scutellaria baicalensis, Prunella vulgaris* L., *Pyrethrum carneum, Ginkgo biloba* L., *Cinchona ledgeriana, Hevea brasiliensis* (wild), *Medicago sativa* Linn, *Piper Nigrum* L.; (10) raw material crops: *Hevea brasiliensis, Ricinus communis, Vernicia fordii, Morus alba* L., Hops *Humulus lupulus, Betula, Alnus cremastogyne* Burk., *Rhus verniciflua* stokes; (11) pasture crops: *Agropyron* spp., *Trifolium* spp., *Miscanthus sinensis, Pennisetum* sp., *Phalaris arundinacea, Panicum virgatum,* prairiegrasses, Indiangrass, Big bluestem grass, *Phleum pratense*, turf, cyperaceae (*Kobresia pygmaea, Carex pediformis, Carex humilis*), *Medicago sativa* Linn, *Phleum pratense* L., *Medicago sativa, Melilotus suavcolen, Astragalus sinicus, Crotalaria juncea, Sesbania cannabina, Azolla imbircata, Eichhomia crassipes, Amorpha fruticosa, Lupinus micranthus, Trifolium, Astragalus adsurgens pall, Pistia stratiotes linn, Altemanthera philoxeroides, Lolium*; (12) sugar crops: *Saccharum* spp., *Beta vulgaris*; (13) beverage crops: *Camellia sinensis, Camellia Sinensis*, tea, Coffee (*Coffea* spp.), *Theobroma cacao, Humulus lupulus* Linn.; (14) lawn plants: *Ammophila arenaria, Poa* spp. (*Poa pratensis* (bluegrass)), *Agrostis* spp. (*Agrostis matsumurae, Agrostis palustris*), *Lolium* spp. (*Lolium*), *Festuca* spp. (*Festuca ovina* L.), *Zoysia* spp. (Zoysiajaponica), *Cynodon* spp. (*Cynodon dactylon*/bermudagrass), *Stenotaphrum secunda* turn (*Stenotaphrum secundatum*), *Paspalum* spp., *Eremochloa ophiuroides* (centipedegrass), *Axonopus* spp. (carpetweed), *Bouteloua dactyloides* (buffalograss), *Bouteloua* var. spp. (*Bouteloua gracilis*), *Digitaria sanguinalis, Cyperusrotundus, Kyllingabrevifolia, Cyperusamuricus, Erigeron canadensis, Hydrocotylesibthorpioides, Kummerowiastriata, Euphorbia humifusa, Viola arvensis, Carex rigescens, Carex heterostachya,* turf; (15) tree crops: *Pinus* spp., *Salix* spp., *Acer* spp., *Hibiscus* spp., *Eucalyptus* spp., *Ginkgo biloba, Bambusa* sp., *Populus* spp., *Prosopis* spp., *Quercus* spp., *Phoenix* spp., *Fagus* spp., *Ceiba pentandra, Cinnamomum* spp., *Corchorus* spp., *Phragmites australis, Physalis* spp., *Desmodium* spp., *Populus, Hedera helix, Populus tomentosa* Carr, *Viburnum odoratissinum, Ginkgo biloba* L., *Quercus, Ailanthus altissima, Schima superba, Ilex purpurea, Platanus acerifolia, ligustrum lucidum, Buxus megistophylla* Levl., *Dahurian larch, Acacia mearnsii, Pinus massoniana, Pinus khasys, Pinus yunnanensis, Pinus finlaysoniana, Pinus tabuliformis, Pinus koraiensis, Juglans nigra, Citrus limon, Platanus acerifolia, Syzygium jambos, Davidia involucrate, Bombax malabarica* L., *Ceiba pentandra* (L.), *Bauhinia blakeana, Albizia saman, Albizzia julibrissin, Erythrina corallodendron, Erythrina indica, Magnolia gradiflora, Cycas revolute, Lagerstroemia indica,* coniferous, macrophanerophytes, Frutex; (16) nut crops: *Bertholletia excelsea, Castanea* spp., *Corylus* spp., *Carya* spp., *Juglans* spp., *Pistacia vera, Anacardium occidentale, Macadamia* (*Macadamia integrifolia*), *Carya* illinoensis Koch, *Macadamia*, Pistachio, Badam, other plants that produce nuts; (17) others: *Arabidopsis thaliana*, Bra chiaria *eruciformis, Cenchrus echinatus, Setaria faberi, Eleusine indica, Cadaba farinose,* algae, *Carex elata,* ornamental plants. *Carissa macrocarpa, Cynara* spp., *Daucus carota, Dioscorea* spp., *Erianthus* sp., *Festuca arundinacea, Hemerocallis fulva, Lotus* spp., *Luzula sylvatica, Medicago sativa, Melilotus* spp., *Morus nigra, Nicotiana* spp., *Olea* spp., *Ornithopus* spp., *Pastinaca sativa, Sambucus* spp., *Sinapis* sp., *Syzygium* spp., *Tripsacum dactyloides, Triticosecale rimpaui, Viola odorata,* and the like.

In the present invention, the term "plant tissue" or "plant part" includes plant cells, protoplasts, plant tissue cultures, plant callus, plant blocks, and plant embryos, pollens, ovules, seeds, leaves, stems, flowers, branches, seedlings, fruits, cores, spikes, roots, root tips, anthers, etc.

In the present invention, the "plant cell" should be understood to mean any cell derived from or found in a plant that is capable of forming, for example, an undifferentiated tissue such as callus, a differentiated tissue such as an embryo, a plant part, a plant or a seed.

For the terms regarding amino acid substitutions used in the specification, the first letter represents a naturally occurring amino acid at a certain position in a particular sequence, the following number represents the position corresponding to the SEQ ID NO: 2, and the second letter represents a different amino acid substituting for the naturally occurring amino acid. For example, A103S represents that the alanine at position 103 is substituted with serine relative to the amino acid sequence of SEQ ID NO: 2. For an amino acid substitution in which the first letter is absent, it is meant that, relative to the amino acid sequence of the wild-type protein, the naturally occurring amino acid at the position corresponding to SEQ ID NO: 2 is substituted with the amino acid represented by the second letter after the number. For double or multiple mutations, each mutation is separated by "/". For example, H141R/G342D/D370N means that, relative to the amino acid sequence of SEQ ID NO: 2, the histidine at position 141 is substituted with arginine, the glycine at position 342 is substituted with aspartic acid, and the aspartic acid at position 370 is substituted with asparagine, and all three mutations are present in the specific mutant HPPD protein.

In one aspect, the present invention discloses a mutant HPPD protein or a bioactive fragment thereof, which retains the activity to catalyze the conversion of p-hydroxyphenylpyruvate (HPP) to homogentisate whilst having improved resistance or tolerance to HPPD-inhibiting herbicides, as compared to a wild-type p-hydroxyphenylpyruvate dioxygenase protein. In particular, the mutant p-hydroxyphenylpyruvate dioxygenase (HPPD) protein according to the present invention has one or more of mutations selected from the group consisting of 93S, 103S, 141R, 141 K, 141 T, 165V, 191I, 220K, 226H, 276W, 277N, 336D, 337A, 338D, 338S, 338Y, 342D, 346C, 346D, 346H, 346S, 346Y, 370N, 377C, 386T, 390I, 392L, 403G, 410I, 418P, 419F, 419L, 419V, 420S, 420T, 430G, and 431 L at one or more positions corresponding to positions 93, 103, 141, 165, 191, 220, 226, 276, 277, 336, 337, 338, 342, 346, 370, 377, 386, 390, 392, 403, 410, 418, 419, 420, 430 and 431 of the amino acid sequence of wild-type rice p-hydroxyphenylpyruvate dioxygenase protein as set forth in SEQ ID NO: 2. Preferably, the amino acid sequence of the mutant p-hydroxyphenylpyruvate dioxygenase protein further has at least 80%, at least 85%, at least 90%, at least 95%, at least 96%, at least 97%, at least 98% or at least 99% sequence identity to the amino acid sequence as set forth in SEQ ID NO: 2. More preferably, the mutant p-hydroxyphenylpyruvate dioxygenase protein has the amino acid sequence as set forth in SEQ ID NO: 2, except that it has one or more amino acid mutations selected from the group consisting of 93S, 103S, 141R, 141K, 141T, 165V, 191I, 220K, 226H, 276W, 277N, 336D, 337A, 338D, 338S, 338Y, 342D, 346C, 346D, 346H, 346S, 346Y, 370N, 377C, 386T, 390I, 392L, 403G, 410I, 418P, 419F, 419L, 419V, 420S, 420T, 430G, and 431 L at one or more positions corresponding to positions 93, 103, 141, 165, 191, 220, 226, 276, 277, 336, 337, 338, 342, 346, 370, 377, 386, 390, 392, 403, 410, 418, 419, 420, 430 and 431 of the amino acid sequence of wild-type rice p-hydroxyphenylpyruvate dioxygenase protein as set forth in SEQ ID NO: 2.

In one embodiment, the amino acid sequence of the mutant p-hydroxyphenylpyruvate dioxygenase protein according to the present invention further has at least 80%, at least 85%, at least 90%, at least 95%, at least 96%, at least 97%, at least 98% or at least 99% sequence identity to the amino acid sequence of the wild-type rice p-hydroxyphenylpyruvate dioxygenase protein as set forth in SEQ ID NO: 2, and has one or more amino acid mutations selected from the group consisting of 93S, 103S, 141R, 141 K. 141 T, 165V, 191I, 220K, 226H, 276W, 277N, 336D, 337A, 338D, 338S, 338Y, 342D, 346C, 346D, 346H, 346S, 346Y, 370N, 377C, 386T, 390I, 392L, 403G, 410I, 418P, 419F, 419L, 419V, 420S, 420T, 430G, and 431 L at one or more positions corresponding to positions 93, 103, 141, 165, 191, 220, 226, 276, 277, 336, 337, 338, 342, 346, 370, 377, 386, 390, 392, 403, 410, 418, 419, 420, 430 and 431 of the amino acid sequence of wild-type rice p-hydroxyphenylpyruvate dioxygenase protein as set forth in SEQ ID NO: 2. Preferably, the mutant p-hydroxyphenylpyruvate dioxygenase protein has the amino acid sequence as set forth in SEQ ID NO: 2, except that it has one or more of mutations selected from the group consisting of R93S, A103S, H141R, H141K, H141T, A165V, V191I, R220K, G226H, L276W, P277N, P336D, P337A, N338D, N338S, N338Y, G342D, R346C, R346D, R346H, R346S, R346Y, D370N, I377C, P386T, L390I, M392L, E403G, K410I, K418P, G419F, G419L, G419V, N420S, N420T, E430G and Y431 L at one or more positions corresponding to 93, 103, 141, 165, 191, 220, 226, 276, 277, 336, 337, 338, 342, 346, 370, 377, 386, 390, 392, 403, 410, 418, 419, 420, 430 and 431 of the amino acid sequence of wild-type rice p-hydroxyphenylpyruvate dioxygenase protein as set forth in SEQ ID NO: 2.

A particular amino acid position (numbering) within the protein of the present invention is determined by aligning the amino acid sequence of a protein of interest with SEQ ID NO: 2 using a standard sequence alignment tool, for example, Smith-Waterman algorithm or Clustal W2 algorithm is used to align two sequences, wherein the sequences are considered to be aligned when the alignment score is the highest. The alignment score can be calculated according to the method described in Wilbur, W. J. and Lipman, D. J. (1983), "Rapid similarity searches of nucleic acid and protein data banks", Proc. Natl. Acad. Sci. USA, 80: 726-730. The default parameters used in the ClustalW2 (1.82) algorithm are preferably: protein gap opening penalty=10.0; protein gap extension penalty=0.2; protein matrix=Gonnet; protein/DNA end gap=−1; and protein/DNA GAPDIST=4.

Preferably, the AlignX program (a part of the vector NTI set) is used to match the default parameters for the multiple alignment (gap opening penalty: 10 og, gap extension penalty: 0.05), and the position of a particular amino acid within a protein of the present invention is determined by aligning the amino acid sequence of the protein with SEQ ID NO: 2.

The identity of amino acid sequences can be determined by conventional methods, for example, by referring to the teachings of Smith and Waterman, (1981, Adv. Appl. Math. 2: 482, Pearson & Lipman, 1988, Proc. Natl. Acad. Sci. USA 85: 2444), algorithms on computer of Thompson et al. (1994, Nucleic Acids Res 22:467380, etc., as determined by computerized (GAP, BESTFIT, FASTA, and TFASTA, Genetics Computer Group in the Wisconsin Genetics software package), or can be determined by using the BLAST algorithm (Altschul et al., 1990, Mol. Biol. 215:403-10) available from the National Center for Biotechnology Information www.ncbi.nlm.nih.gov/) with the default parameters.

In one further embodiment, the mutant p-hydroxyphenylpyruvate dioxygenase protein according to the present invention has an amino acid sequence as set forth in SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO:

54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82 or EQ ID NO: 84.

In one further embodiment, the mutant p-hydroxyphenylpyruvate dioxygenase (HPPD) protein according to the present invention has the following amino acid mutations in its amino acid sequence:

H141R/G342D, H141R/D370N, G342D/D370N, H141R/N338D,

H141R/G342D, N338D/G342D, K418P/G419F, G419F/N420S,

G342D/R346C, G342D/R346H, H141R/N420S, G338D/K418P,

P277N/N338D, L276W/P277N, H141R/G342D/D370N,

H141R/N338D/N420S, H141R/N338S/N420S,

P336D/N338D/G342D, P336D/N338S/G342D,

P336D/N338Y/G342D, N338D/G342D/R346C,

N338D/G342D/R346H, N338D/G342D/R346S,

N338S/G342D/R346C, N338S/G342D/R346H,

N338S/G342D/R346S, N338Y/G342D/R346C,

N338Y/G342D/R346H, N338Y/G342D/R346S,

P336D/G342D/R346C, P336D/G342D/R346H,

P336D/G342D/R346S, P336D/N338D/R346C,

P336D/N338D/R346H, P336D/N338D/R346S

P336D/N338S/R346C, P336D/N338S/R346H,

P336D/N338S/R346S, P336D/N338Y/R346C,

P336D/N338Y/R346H, P336D/N338Y/R346S,

H141R/N338D/G342D, H141R/G342D/K418P,

H141R/G342D/G419F, H141R/G342D/P386T,

K418P/G419F/N420T, K418T/G419F/N420T,

H141R/G342D/R346C, H141R/G342D/R346H,

H141R/G342D/N420S, H141R/G342D/P277N,

H141R/G342D/P336D, H141R/G342D/L276W,

H141R/G342D/R346S, H141R/G342D/L390I,

H141R/G342D/I377C, H141R/G342D/M392L,

H141R/P337A/G342D, H141R/N338S/G342D,

H141R/N338Y/G342D, P277N/N338D/G342D,

P277N/G342D/R346C, P277N/N338D/N420S,

N338D/G342D/K418P, H141R/N338D/G342D/K418P,

H141R/N338D/G342D/G419F, H141R/N338D/G342D/P386T,

H141R/N338D/G342D/R346C, H141R/N338D/G342D/R346H,

H141R/G342D/K418P/G419F, H141R/G342D/L276W/P277N,

P336D/N338D/G342D/R346C, P336D/N338D/G342D/R346H,

P336D/N338D/G342D/R346S, P336D/N338S/G342D/R346C,

P336D/N338S/G342D/R346H, P336D/N338S/G342D/R346S,

P336D/N338Y/G342D/R346C, P336D/N338Y/G342D/R346H,

P336D/N338Y/G342D/R346S, P277N/P336D/N338D/G342D,

P277N/N338D/G342D/R346C, P277N/N338D/K418P/G419F,

H141R/N338D/G342D/K418P/G419F,

H141R/N338D/G342D/G419F/N420S,

H141R/G336D/G342D/K418P/G419F/N420S,

H141R/N338D/G342D/K418P/G419F/N420S,

H141R/N338D/G342D/K418P/G419F/N420T,

H141R/N338D/G342D/R346C/K418P/G419F/N420S,

H141R/N338D/G342D/R346H/K418P/G419F/N420S,

H141R/P277N/N338D/G342D/K418P/G419F/N420S, or

H141R/P277N/P336D/N338D/G342D/K418P/G419F/N420S.

In yet further embodiment, the mutant p-hydroxyphenylpyruvate dioxygenase protein according to the present invention has an amino acid sequence as set forth in SEQ ID NO: 24, SEQ ID NO: 26, SEQ ID NO: 28, SEQ ID NO: 30, SEQ ID NO: 86, SEQ ID NO: 88, SEQ ID NO: 90, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 254, SEQ ID NO: 256, SEQ ID NO: 258 or EQ ID NO: 260.

In the present invention, the wild-type p-hydroxyphenylpyruvate dioxygenase protein can be derived from any plant, particularly the aforementioned monocotyledonous or dicotyledonous plants. The sequences of some wild-type p-hydroxyphenylpyruvate dioxygenase proteins from other sources and coding sequences thereof are disclosed in the prior technical literatures, which are incorporated herein by reference.

Preferably, the wild-type p-hydroxyphenylpyruvate dioxygenase protein of the present invention is derived from *Oryza*, particularly *Oryza sativa*. More preferably, the wild-type p-hydroxyphenylpyruvate dioxygenase protein has the amino acid sequence as set forth in SEQ ID NO: 2, or at least 80%, at least 85%, at least 90%, at least 95%, at least 96%, at least 97%, at least 98%, or at least 99% sequence identity to the amino acid sequence as set forth in SEQ ID NO: 2.

It will also be apparent for a person skilled in the art that the structure of a protein can be altered, without adversely affecting its activity and functionality, for example, one or more conservative amino acid substitutions can be introduced into the amino acid sequence of the protein without adversely affecting the activity and/or three-dimensional configuration of the protein molecule. A person skilled in the art knows examples and embodiments of conservative amino acid substitutions. Specifically, an amino acid residue at certain site may be substituted with another amino acid residue belonging to the same group as the amino acid to be substituted, that is, a non-polar amino acid residue is substituted with another non-polar amino acid residue, a polar uncharged amino acid residue is substituted with another polar uncharged amino acid residue, a basic amino acid residue is substituted with another basic amino acid residue, and an acidic amino acid residue is substituted with an acidic amino acid residue. As long as a substitution does not impair the biological activity of the protein, such a conservative substitution that one amino acid is substituted by other amino acid which belong to the same group falls within the scope of the present invention.

Accordingly, the mutant HPPD protein of the present invention may further contain one or more other mutations such as conservative substitutions in the amino acid sequence in addition to the above mutations. In addition, the invention also encompasses mutant HPPD proteins that further contain one or more other non-conservative substitutions, so long as the non-conservative substitutions do not significantly affect the desired function and biological activity of the protein of the present invention.

As is well known in the art, one or more amino acid residues can be deleted from the N- and/or C-terminus of a protein, and the protein still retains the function and activity. Accordingly, in another aspect, the present invention also relates to fragments which lack one or more amino acid residues at the N- and/or C-terminus of a mutant p-hydroxyphenylpyruvate dioxygenase (HPPD) protein while retaining the desired function and activity. Within the scope of the invention, and the fragments are referred to as bioactive fragments. In the present invention, the "bioactive fragment" refers to a portion of a mutant HPPD protein of the present invention which retain the biological activity of the mutant HPPD protein of the present invention while having improved resistance or tolerance to HPPD inhibitors as compared to a HPPD fragment having no the mutation(s). For example, a bioactive fragment of a mutant HPPD protein may be a bioactive fragment that lacks a moiety of one or more (for example, 1-50, 1-25, 1-10 or 1-5, e.g., 1, 2, 3, 4 or 5) of amino acid residues at the N- and/or C-terminus of the protein, but still retains the desired biological activity of the full-length protein.

The present invention also provides a fusion protein comprising a mutant HPPD protein or a bioactive fragment thereof according to the present invention and an additional component that is fused thereto. In one preferred embodiment, the additional component is a plastid-directed peptide, such as a chloroplast-directed peptide, which enables the mutated HPPD protein to target for chloroplast. In another embodiment, the additional component is a tag peptide, such as 6×His. In yet another embodiment, the additional component is a peptide that contributes to increasing the solubility of the mutant HPPD protein, such as a NusA peptide.

In yet another aspect, the present invention provides an isolated polynucleotide comprising a nucleic acid sequence encoding an above-described mutation p-hydroxyphenylpyruvate dioxygenase (HPPD) protein or a bioactive fragment thereof, or a complementary sequence thereof. The term "isolated" polynucleotide means that the polynucleotide does not substantially comprise components normally associated therewith in a naturally occurring environment. In one embodiment, the amino acid sequence of the mutant p-hydroxyphenylpyruvate dioxygenase (HPPD) protein has at least 80%, at least 85%, at least 90%, at least 95%, at least 96%, at least 97%, at least 98% or at least 99% sequence identity to the amino acid sequence as set forth in SEQ ID NO: 2, and further has one or more amino acid mutations selected from the group consisting of 93S, 103S, 141R, 141K, 141T, 165V, 191I, 220K, 226H, 276W, 277N, 336D, 337A, 338D, 338S, 338Y, 342D, 346C, 346D, 346H, 346S, 346Y, 370N, 377C, 386T, 390I, 392L, 403G, 410I, 418P, 419F, 419L, 419V, 420S, 420T, 430G, and 431 L at one or more positions corresponding to positions 93, 103, 141, 165, 191, 220, 226, 276, 277, 336, 337, 338, 342, 346, 370, 377, 386, 390, 392, 403, 410, 418, 419, 420, 430 and 431 of the amino acid sequence of wild-type rice p-hydroxyphenylpyruvate dioxygenase protein as set forth in SEQ ID NO: 2. Preferably, the mutation is one or more mutations selected from the group consisting of R93S, A103S, H141R, H141 K, H141T, A165V, V191 I, R220K, G226H, L276W, P277N, P336D, P337A, N338D, N338S, N338Y, G342D, R346C, R346D, R346H, R346S, R346Y, D370N, 1377C, P386T, L390I, M392L, E403G, K410I, K418P, G419F, G419L, G419V, N420S, N420T, E430G and Y431 L. More preferably, the mutant p-hydroxyphenylpyruvate dioxygenase (HPPD) protein or bioactive fragment thereof is derived from a rice HPPD protein and has one or more amino acid substitutions selected from the above those.

It will be apparent for a person skilled in the art that a variety of different nucleic acid sequences can encode the amino acid sequences disclosed herein due to the degeneracy of genetic codes. A person skilled in the art is able to generate additional nucleic acid sequences encoding a same protein, and thus the present invention encompasses nucleic acid sequences encoding the same amino acid sequence due to the degeneracy of genetic codes. For example, in order to achieve high expression of a heterologous gene in a host organism, such as a plant, the gene can be optimized using host-preferred codons for better expression.

Accordingly, in some embodiments, the polynucleotide of the present invention has a nucleic acid sequence selected from:

(1) a nucleic acid sequence encoding an amino acid sequence as set forth in: SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 254, SEQ ID NO: 256, SEQ ID NO: 258 or SEQ ID NO: 260, or a complementary sequence thereof;

(2) a nucleic acid sequence as set forth in: SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 253, SEQ ID NO: 255, SEQ ID NO: 257 or EQ ID NO: 259, or complementary sequence thereof.

(3) a nucleic acid sequence that hybridizes to the sequence shown in (1) or (2) under stringent conditions; and (4) a nucleic acid sequence encoding an amino acid sequence same as a sequence shown in (1) or (2) due to degeneracy of genetic code, or a complementary sequence thereof.

Further preferably, the polynucleotide of the present invention has a nucleic acid sequence selected from the nucleic acid sequence as set forth in: SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 253, SEQ ID NO: 255, SEQ ID NO: 257 or EQ ID NO: 259, or complementary sequence thereof.

Preferably, the stringent conditions may refer to conditions of 6M urea, 0.4% SDS and 0.5×SSC or hybridization conditions equivalent thereto, and may also refer to conditions with higher stringency, such as 6M urea, 0.4% SDS, 0.1×SSC or hybridization conditions equivalent thereto. In various conditions, the temperature may be above about 40° C., for example, when conditions with higher stringency are required, the temperature may be, such as, about 50° C., and further may be about 65° C.

More preferably, the wild-type and mutant codons corresponding to the amino acid mutation sites are in chart below:

| Amino acid mutation sites | Wild-type codons | Mutant codons |
|---|---|---|
| A103S | GCC | TCG;TCA;TCC;TCT;AGC;AGT |
| H141R | CAC | CCG;CGA;CGC;CGT;AGG;AGA |
| H141K | CAC | AAG;AAA |
| H141T | CAC | ACC;ACT;ACA;ACG |
| A165V | GCG | GTG;GTA;GTC;GTT |
| V191I | GTC | ATA;ATC;ATT |
| R220K | CGG | AAG;AAA |
| G342D | GGC | GAC;GAT |
| D370N | GAC | AAC;AAT |
| K410I | AAG | ATA;ATC;ATT |
| R93S | CGC | AGC;AGT;TCA;TCC;TCG;TCT |
| G226H | GGC | CAC;CAT |
| L276W | CTG | TGG |
| P277N | CCG | AAC;AAT |
| P336D | CCG | GAT;GAC |
| P337A | CCC | GCA;GCC;GCG;CGT |
| N338D | AAC | GAC;GAT |
| N338S | AAC | AGC;TCG;TCA;TCC;TCT;AGT |
| N338Y | AAC | TAC;TAT |
| G342D | GGC | GAC;GAT |
| R346C | CGC | TGC;TGT |
| R346H | CGC | CAC;CAT |
| R346S | CGC | AGC;TCG;TCA;TCC;TCT;AGT |
| R346D | CGC | GAC;GAT |
| R346Y | CGC | TAC; TAT |
| I377C | ATC | TGC;TGT |
| P386T | CCA | ACA;ACC;ACG;ACT |
| L390I | TTG | ATA;ATC;ATT |
| M392L | ATG | CTA;CTC;CTG;CTT;TTA;TTG |
| E403G | GAG | GGA;GGC;GGG;GGT |
| P418P | AAG | CCA;CCC;CCG;CCT |
| G419F | GGC | TTC;TTT |
| G419L | GGC | CTA;CTC;CTG;CTT;TTA;TTG |
| G419V | GGC | GTA;GTC;GTG;GTT |
| N420S | AAC | AGC;TCG;TCA;TCC;TCT;AGT |
| N420T | AAC | ACA;ACC;ACG;ACT |
| E430G | GAG | GGA;GGC;GGG;GGT |
| Y431L | TAT | CTA;CTC;CTG;CTT;TTA;TTG |

The present invention also provides a nucleic acid construct comprising a nucleic acid sequence encoding a mutant p-hydroxyphenylpyruvate dioxygenase protein or a bioactive fragment thereof or a fusion protein thereof according to the present invention, and one or more regulatory elements operably linked thereto. The term “regulatory element” as used in the present invention refers to a nucleic acid sequence capable of modulating the transcription and/or translation of a nucleic acid operably linked thereto.

The regulatory element may be a suitable promoter sequence that is recognized by a host cell for expression of a nucleic acid sequence encoding a protein of the present invention. The promoter sequence comprises a transcriptional regulatory sequence that mediates the expression of the protein. The promoter may be any nucleotide sequence that exhibits transcriptional activity in a selected host cell, including mutated, truncated and hybrid promoters, and may be obtained from a gene encoding an extracellular or intracellular polypeptide that is homologous or heterologous to the gene of the host cell. As a promoter expressed in a plant cell or a plant, a naturally occurring promoter of the p-hydroxyphenylpyruvate dioxygenase or a heterologous promoter having activity in the plant can be used. The promoter may lead to a constitutive expression or inducible expression. Examples of the promoter include, for example, histone promoter, rice actin promoter, a plant viral promoter such as cauliflower mosaic virus promoter, and the like.

The regulatory element may also be a suitable transcription terminator sequence that is recognized by the host cell to terminate the transcription. The terminator sequence is operably linked to the 3' end of a nucleic acid sequence encoding a protein of the invention. Any terminator that functions in a selected host cell can be used in the present invention.

The regulatory element may also be a suitable leader sequence, i.e., an untranslated region of mRNA that is important for translation in a host cell. The leader sequence is operably linked to the 5' end of a nucleic acid sequence encoding a protein of the invention. Any leader sequence that functions in a selected host cell can be used in the present invention.

The regulatory element may also be a polyadenylation sequence, i.e., a sequence operably linked to the 3' end of the nucleic acid sequence and recognized by a host cell as a signal for addition of polyadenylic acid residues to the transcribed mRNA during transcription. Any polyadenylation sequence that functions in a selected host cell can be used in the present invention.

The regulatory element may also be a signal peptide coding region that encodes an amino acid sequence linked to the amino terminus of a protein and directs the encoded protein into secretory pathway in cells. The 5' end of the coding sequence of the nucleic acid sequence may inherently comprise a signal peptide coding region that is natively linked to the coding region encoding the secreted polypeptide within the translational reading frame. Alternately, the 5' end of the coding sequence may comprise a signal peptide coding region that is foreign to the coding sequence. A foreign signal peptide coding region may be required where a coding sequence does not natively comprise a signal peptide coding region. Alternately, the foreign signal peptide coding region may simply replace the native signal peptide coding region to facilitate secretion of the polypeptide. In any event, any signal peptide coding region that directs an expressed polypeptide into secretory pathway in a selected host cell, i.e., the secretion of the polypeptide into a culture medium, may be used in the present invention.

Regulatory sequences that allow expression of the polypeptide to be regulated according to growth of a host cell can also be suitably added. Regulatory systems include, for example, regulatory systems that enable gene expression to turn on or off in response to chemical or physical stimuli, (including the presence of regulatory compounds), such as lac, tec, and tip operon systems, ADH2 systems or GAL1 systems, and the like. Examples of other regulatory sequences are those that allow for gene amplification. In a eukaryotic system, these include dihydrofolate reductase gene that is amplified in the presence of methotrexate, and metallothionein gene that is amplified due to heavy metals. In these cases, the nucleotide sequence encoding the polypeptide will be operably linked to the regulatory sequence.

In the present invention, the regulatory element may also be a transcriptional activator, i.e., an enhancer, for example, the tobacco mosaic virus translation activator described in WO87/07644, or an intron, etc., such as maize adh1 intron, maize bronze 1 gene intron or rice actin intron 1. They can enhance the expression of a mutant HPPD protein, a bioactive fragment thereof or a fusion protein according to the present invention in a transgenic plant.

The present invention also provides an expression vector comprising a nucleic acid sequence encoding a mutant p-hydroxyphenylpyruvate dioxygenase protein or a bioactive fragment thereof or a fusion protein according to the present invention, and an expression regulatory element operably linked thereto. The expression vector also contains at least one origin of replication for self-replication. The choice of a vector will generally depend on the compatibility of the vector with a host cell into which the vector is to be introduced. The vector can be an autonomously replicating vector, i.e., a vector that exists as an extrachromosomal entity, and its replication is independent of chromosomal replication, such as plasm ids, extrachromosomal elements, minichromosomes, or artificial chromosomes. The vector can contain any element that ensures self-replication. Alternately, the vector can be a vector that is integrated into the genome of a host cell when introduced into the host cell and replicated together with the chromosome into which it is integrated. In addition, a single vector or plasmid, or two or more vectors or plasmids together with comprising a total DNA to be introduced into the genome of a host cell, or a transposon, may be used. Alternately, the vector can also be a vector for gene editing of the endogenous HPPD gene of the host cell.

The vector can be a plasmid, a virus, a cosmid, or a phage, and the like, which is well known to a person skilled in the art and is numerously described in the art. Preferably, the expression vector in the present invention is a plasmid. The expression vector can comprise a promoter, a ribosome binding site of translation initiation, a polyadenylation site, a transcription terminator, an enhancer, and the like. Such a selectable marker includes a gene encoding dihydrofolate reductase, a gene conferring tolerance to neomycin, a gene conferring tolerance to tetracycline or ampicillin, and the like.

The vector of the present invention can comprise elements that allow for the integration of the vector into the genome of a host cell or autonomous replication independent of the genome in the cell. For integration into the genome of a host cell, the vector may rely on a polynucleotide sequence encoding the polypeptide or any other element of the vector which is suitably be integrated into the genome by homologous or non-homologous recombination. Alternately, the vector can comprise an additional nucleotide sequence for directing integration of the vector into the genome of a host cell at an exact location of the chromosome by homologous recombination. In order to increase the likelihood of integration at the exact position, an integration element should preferably comprise a sufficient number of nucleic acids, such as from 100 to 10,000 base pairs, preferably from 400 to 10,000 base pairs, more preferably from 800 to 10,000 base pairs, which is highly identical to a corresponding target sequence so as to increase the probability of homologous recombination. The integration element may be any sequence homologous to a target sequence within the genome of a host cell. Furthermore, the integration element may be a non-coding or coding nucleotide sequence. In another aspect, the vector may be integrated into the genome of a host cell by non-homologous recombination. For autonomous replication, the vector may further comprise an origin of replication enabling the vector to be replicated autonomously in the host cell. The origin of replication may be any plasmid replicon that mediates autonomous replication and functions in a cell. The term "origin of replication" or "plasmid replicon" is defined herein as a nucleotide sequence that enables a plasm id or vector to be replicated in vivo.

The polynucleotide with more than one copy of the present invention is inserted into a host cell to increase the yield of a gene product. An increase in the number of polynucleotide copies can be achieved by integrating a sequence with at least one additional copy into the genome of a host cell or by combining an amplifiable selectable marker gene with the polynucleotide together. In the latter case, the cell comprising the selectable marker gene with amplified copy and the polynucleotide with the additional copy can be screened by artificially culturing the cell in the presence of a suitable selectable formulation.

A nucleic acid sequence of the present invention can be inserted into a vector by a variety of methods, for example, by digesting the insert and the vector with an appropriate restriction endonuclease and then performing ligation. A variety of cloning techniques are known in the art and are within the scope of knowledge of a person skilled in the art.

Vectors suitable for use in the present invention include commercially available plasmids, for example, but not limited to, pBR322 (ATCC 37017), pKK223-3 (Pharmacia Fine Chemicals, Uppsala, Sweden), GEM1 (Promega Biotec, Madison, WI, USA). pQE70, pQE60, pQE-9 (Qiagen), pD10, psiX174 pBluescript II KS, pNH8A, pNH16a, pNH18A, pNH46A (Stratagene), ptrc99a, pKK223-3, pKK233-3, pDR540, pRIT5 (Pharmacia), pKK232-8, pCM7, pSV2CAT, pOG44, pXT1, pSG (Stratagene), pSVK3, pBPV, pMSG, and pSVL (Pharmacia) and the like.

The invention also provides a host cell comprising a nucleic acid sequence, a nucleic acid construct or an expression vector according to the present invention. A vector of the present application is introduced into a host cell such that the vector is present as part of a chromosomal integrant or as an extra-chromosomal vector for self-replication as described previously, or the vector can genetically edit the endogenous HPPD gene in the host cell. The host cell can be any host cell familiar to a person skilled in the art, including prokaryotic cells and eukaryotic cells, such as bacterial cells, fungal cells, yeast cells, mammalian cells, insect cells or plant cells, examples of which are *E. coli, Streptomyces, Bacillus subtilis, Salmonella typhimurium, Pseudomonas, Streptomyces, Staphylococcus, Spodoptera* Sf9, CHO, COS, etc. A person skilled in the art is able to select an appropriate host cell.

In the present invention, the term "host cell" also encompasses any progeny of parental cell that is not completely identical to the parent cell due to mutations that occur during replication.

A nucleic acid sequence, a nucleic acid construct or an expression vector of the present invention can be introduced into a host cell by a variety of techniques, including transformation, transfection, transduction, viral infection, gene gun or Ti-plasmid mediated gene delivery, and calcium phosphate transfection, DEAE-dextran mediated transfection, lipofection or electroporation and the like (see Davis, L., Dibner, M., Battey, I., Basic Methods in Molecular Biology, 1986).

In a specific embodiment, the mutant HPPD protein of the present invention can be targeted to a plastid in a plant, such as a chloroplast. This can be achieved by ligating a nucleic acid sequence encoding the mutant HPPD protein of the present invention into a reading frame of a nucleic acid sequence encoding a plastid-directed peptide, such as a chloroplast-directed peptide, or this can be achieved by directly transforming a polynucleotide, a nucleic acid construct or an expression vector of the present invention into the chloroplast genome of a plant cell. A person skilled in the art knows vectors and methods that can be used to transform the chloroplast genomes of plant cells. For example, a nucleic acid sequence encoding a mutant HPPD protein of the present invention can be integrated by bombarding the leaves of a target plant with DNA-coated ions and by means of homologous recombination or non-homologous recombination.

Where appropriate, the transformed host cells can be cultured in conventional nutrient media. After transforming a suitable host cell and culturing the host cell to an appropriate cell density, the selected promoter can be induced by a suitable method such as temperature change or chemical induction, and the cells can be cultured for an additional period of time to a mutant HPPD protein or a bioactive fragment thereof or fusion protein according to the present invention.

Accordingly, the present invention also relates to a method of producing a mutant HPPD protein or a bioactive fragment thereof or a fusion protein according to the present invention, comprising: (a) cultivating said host cell under conditions conducive for production of said mutant HPPD protein or bioactive fragment thereof or fusion protein; and (b) recovering the mutant HPPD protein or bioactive fragment thereof or fusion protein.

In the producing method of the present invention, the cells are cultured on a nutrient medium suitable to produce the polypeptide by methods well known in the art. For example, the cells are cultivated means of shaft flask culture and small-scale or large-scale fermentation (including continuous, batch, feeding in batch, or solid-state fermentation) in a suitable culture medium in laboratory or industrial fermenter under conditions that permit expression and/or isolation of the polypeptide. The cultivation is carried out on a suitable nutrient medium comprising carbon and nitrogen sources and inorganic salts by procedures known in the art. Suitable media can be purchased from a supplier or formulated in accordance with compositions disclosed (e.g., those on the catalogue of the American Type Culture Collection). If the polypeptide is secreted into the nutrient medium, the polypeptide can be recovered directly from the culture medium. If the polypeptide is not secreted into the medium, it can be recovered from the cell lysates.

The polypeptide can be detected by methods known in the art to be specific for the polypeptide. These detection methods can comprise the use of specific antibodies, formation of enzyme products, or loss of enzyme substrates.

The produced polypeptide can be recovered by methods known in the art. For example, cells can be collected by centrifugation and disrupted by physical or chemical means, and a resulting crude extract is retained for further purification. The transformed host cells expressing a mutation HPPD protein or a bioactive fragment thereof or a fusion protein according to the present invention can be lysed by any convenient means, including freeze-thaw cycles, sonication, mechanical disruption, or using a cell lysing agent. These methods are well known for a person skilled in the art. A mutant HPPD protein or a bioactive fragment thereof according to the present invention can be recovered and purified from a culture of the transformed host cell, and a method used includes ammonium sulfate or ethanol precipitation, acid extraction, anion or cation exchange chromatography, phosphocellulose chromatography, hydrophobic interaction chromatography, affinity chromatography, hydroxyapatite chromatography, and phytohemagglutinin chromatography, and the like.

The invention also relates to a method for preparing a host organism, in particular, a plant cell, a plant tissue, a plant part or a plant, which is tolerant or resistant to an HPPD-inhibiting herbicide, comprising transforming the host organism with a nucleic acid sequence encoding a mutant HPPD protein or a bioactive fragment thereof according to the present invention or a nucleic acid structure or an expression vector comprising the nucleic acid sequence. Methods for transforming a host cell, such as a plant cell, are known in the art, including, for example, protoplast transformation, fusion, injection, electroporation, PEG-mediated transformation, ion bombardment, viral transformation, Agrobacterium-mediated transformation, electroporation perforation or bombardment, and the like. A series of such transformation methods are described in the prior art, for example, the technique for soybean transformation described in EP1186666, and suitable techniques for transforming monocotyledonous plants, especially rice, described in WO 92/09696. It is also advantageous to culture plant explants with *Agrobacterium tumefaciens* or *Agrobacterium rhizogenes* so as to transfer DNA into a plant cell. A whole plant can then be regenerated from an infected plant material part (such as leaf fragments, stem segments, roots, and protoplasts or suspension cultured cells) in a suitable culture medium, which may contain antibiotics or pesticides for selection. Transformed cells are grown in plants in a usual manner, they can form germ cells and transfer transformed traits to progeny plants. Such plants can be cultured in a normal manner and crossed with plants having the same transformed genetic factors or other genetic factors. The resulting hybrid individuals have corresponding phenotypic properties.

The invention also provides a method for preparing a host organism, in particular, a plant cell, a plant tissue, a plant part or a plant, which is tolerant or resistant to an HPPD-inhibiting herbicide, comprising integrating a nucleic acid encoding a mutant p-hydroxyphenylpyruvate dioxygenase protein or a bioactive fragment thereof according to the present invention into the genome of the host organism and expressing the nucleic acid. Suitable vectors and selectable markers are well known for a person skilled in the art, for example, a method of integration into the tobacco genome is described in WO06/108830, and the disclosures contained therein are incorporated herein by reference. The gene(s) of interest are preferably expressed either by constitutive or inducible promoters in the plant cell. Once expressed, the mRNA is translated into proteins, thereby incorporating amino acids of interest into protein. The genes encoding a protein expressed in the plant cells can be under the control of a constitutive promoter, a tissue-specific promoter, or an inducible promoter. For example, promoters of bacterial origin, such as the octopine synthase promoter, the nopaline synthase promoter, and the mannopine synthase promoter, promoters of viral origin, such as the cauliflower mosaic virus (35S and 19S), 35T (which is a re-engineered 35S promoter, see U.S. Pat. No. 6,166,302, especially Example 7E) can be used. Plant promoter regulatory elements can also be used, which includes but is not limited to ribulose-1,6-bisphosphate (RU BP) carboxylase small subunit (ssu), β-conglycinin promoter, β-phaseolin promoter, ADH promoter, heat-shock promoters, and tissue specific promoters. Constitutive promoter regulatory elements may also be used thereby directing continuous gene expression in all cell types and all the time (e.g., actin, ubiquitin, CaMV 35S, and the like). Tissue specific promoter regulatory elements are responsible for gene expression in specific cell or tissue types, such as the leaves or seeds (e.g., zein, oleosin, napin, ACP, globulin and the like) and these may also be used in the present invention. Promoter regulatory elements may also be active (or inactive) during a certain stage of the plant's development. Examples of such include but are not limited to pollen-specific, embryo-specific, corn-silk-specific, cotton-fiber-specific, root-specific, seed-endosperm-specific, or vegetative phase-specific promoter regulatory elements and the like. Under certain circumstances it may be desirable to use an inducible promoter regulatory element, which is responsible for expression of genes in response to a specific signal, such as: physical stimulus (heat shock genes), light (RUBP carboxylase), hormone (Em), metabolites, chemical (tetracycline responsive), and stress. Other desirable transcription and translation elements that function in plants may be used.

The present invention also provides a method of improving the resistance or tolerance of a plant cell, plant tissue, plant part or plant to the HPPD-inhibiting herbicide, comprising transforming the plant or plant part with a nucleic acid molecule comprising a nucleic acid sequence encoding a mutant HPPD protein or a bioactive fragment thereof or a fusion protein according to the present invention and expressing the nucleic acid molecule. The nucleic acid molecule can be expressed as an extrachromosomal entity, or can be expressed by integrating it into the genome of a plant cell, particularly, can be expressed by integrating it into the endogenous gene position of a plant cell through homologous recombination. These embodiments are all within the scope of the present invention.

The present invention also provides a method of improving the resistance or tolerance of a plant or a part thereof to the HPPD-inhibiting herbicide, comprising crossing a plant expressing a mutant p-hydroxyphenylpyruvate dioxygenase (HPPD) protein or a bioactive fragment thereof or a fusion protein according to the present invention with another plant, and screening for a plant having improved resistance and tolerance to HPPD-inhibiting herbicides.

The present invention also provides a method of improving the resistance or tolerance of a plant cell, plant tissue, plant part or plant to the HPPD-inhibiting herbicide, comprising gene editing an endogenous HPPD protein gene of the plant cell, plant tissue, plant part or plant to achieve expression of a mutant p-hydroxyphenylpyruvate dioxygenase (HPPD) protein or a bioactive fragment thereof or a fusion protein according to the present invention.

The present invention also relates to a method for preparing a plant that is tolerant or resistant to herbicide by traditional breeding techniques, which comprises self-crossing or crossing a plant in which a nucleic acid sequence encoding a mutant p-hydroxyphenylpyruvate dioxygenase protein or a bioactive fragment thereof according to the present invention is integrated into the genome, and screening out a progeny comprising heterozygously or homozygously nucleic acid sequence.

The invention further relates to a plant cell, a plant tissue, a plant part and a plant obtained by the above method, and progenies thereof.

Preferably, a plant cell, a plant tissue or a plant part transformed with a polynucleotide according to the present invention can be regenerated into a whole plant. The present invention includes cell cultures, including tissue cell cultures, liquid cultures, and solid plate cultures. Seeds produced by the plants of the present invention and/or used to regenerate the plants of the present invention are also included within the scope of the present invention. Other plant tissues and parts are also included in the present invention. The present invention also encompasses a method of producing a plant or a cell comprising a nucleic acid molecule of the present invention. A preferred method of producing such a plant comprising planting a seed of the present invention. A plant transformed in this manner can be endowed with resistance to a variety of herbicides having different modes of action.

For example, for transformation of plant cells using *Agrobacterium*, explants may be combined and incubated with the transformed *Agrobacterium* for enough time to allow transformation thereof. After transformation, the Agrobacteria are killed by selection with the appropriate antibiotic and plant cells are cultured with the appropriate selective medium. Once calli are formed, shoot formation can be promoted by employing the appropriate plant hormones according to methods well known in the art of plant tissue culturing and plant regeneration. However, a callus intermediate stage is not always necessary. After shoot formation, said plant cells can be transferred to medium which promotes root formation thereby completing plant regeneration. The plants may then be grown to seed and said seed can be used to establish future generations. Regardless of transformation technique, the gene encoding a bacterial protein is preferably incorporated into a gene transfer vector adapted to express said gene in a plant cell by including in the vector a plant promoter regulatory element, as well as 3' non-translated transcriptional termination regions such as Nos and the like.

The present invention also provides a method for controlling weeds in a plant cultivation site, comprising applying to the locus comprising plants or seeds according to the present invention a herbicidally effective amount of one or more HPPD-inhibiting herbicide.

In the present invention, the term "cultivation site" includes a site in which plants of the present invention are cultivated, such as soil, and also includes, for example, plant seeds, plant seedlings, and grown plants. The term "herbicidally effective amount" means the amount of an herbicide that is enough to affect the growth or development of target weeds, for example, preventing or inhibiting the growth or development of the target weeds, or killing the weeds. Advantageously, said herbicidally effective amount does not significantly affect the growth and/or development of a plant seed, plant seedling or plant of the present invention. A person skilled in the art can determine such a herbicidally effective amount through conventional experiments.

The present invention also provides a method for producing a mutant p-hydroxyphenylpyruvate dioxygenase (HPPD) protein which retains or enhances the property of catalyzing the conversion of p-hydroxyphenylpyruvate (HPP) to homogentisate and is significantly less sensitive to HPPD-inhibiting herbicides than a wild-type HPPD, comprising the steps of: mutating a nucleic acid encoding a wild-type HPPD, fusing and ligating consistently the mutated nucleic acid in an expression vector to a nucleic acid reading frame sequence encoding a solubility-enhancing component to form a sequence encoding a fusion protein, transforming the obtained recombinant expression vector into a host cell, expressing the fusion protein under suitable conditions containing the HPPD-inhibiting herbicide and a HPPD enzymatic substrate, and screening out a mutant p-hydroxyphenylpyruvate dioxygenase (HPPD) protein which retains or enhances the property of catalyzing the conversion of p-hydroxyphenylpyruvate (HPP) to homogentisate and has significantly reduced sensibility to the HPPD-inhibiting herbicide. Preferably, the solubility-enhancing component is preferably selected from NusA, which forms a fusion protein with the mutant HPPD protein of the present invention. More preferably, the expression vector is selected from pET-44a vector. The host cell is selected from a bacterial cell, a fungal cell or a plant cell.

Unless specifically stated or implied, the terms "a", "an" and "the" used herein mean "at least one". All patents, patent applications, and publications mentioned or cited herein are incorporated herein by reference in their entirety, and the citation degree thereof is the same as that of individual citation.

DETAILED EMBODIMENTS OF THE INVENTION

The present invention will be further described in conjunction with the examples below. All of the methods and operations described in the examples are provided by way of exemplifications and should not be construed as limitation. As for methods of DNA manipulation, please see Current Protocols in Molecular Biology, Volumes 1 and 2, Ausubel F. M., Greene Publishing Associates and Wiley Interscience, 1989, Molecular Cloning, T. Maniatis et al., 1982, or Sambrook J. and Russell D., 2001, Molecular Cloning: a laboratory manual, version 3.

EXAMPLES

Example 1 Cloning of Rice Hppd (Oshppd) Gene

The rice (*Oryza sativa, Japonica* Group) 4-hydroxyphenylpyruvate dioxygenase (HPPD) gene is located at a site of second chromosome, Os02g0168100. A coding region DNA (OsHPPD) (General Biosystems, Chuzhou, Anhui Province, China) was directly synthesized according to the corresponding cDNA sequence (NCBI Accession No. XP_015626163.1) and it is used as a PCR template. The primers NusOsF: acgattgatgacgacgacaag ATGCCTCCCACTCCCACCCC and NusOsR: tccacgagctcccggactc TTA CTAGGATCCTTGAACTGTAG were designed and synthesized according to the sequences of the vector pET-44a (Novagen) and XP015626163.1. The PCR amplification was carried out by using these primers, the synthesized template and Q5 DNA polymerase (NEB, New England Biolabs, Boston, USA). The amplification was carried out under the following conditions: 98° C. for 2 minutes; then 98° C. for 20 seconds, 65° C. for 30 seconds, and 72° C. for 60 seconds, 35 cycles; and 72° C. for 2 minutes. The amplified fragment was shown to be 1.3 Kb in agarose gel electrophoresis and the DNA concentration thereof was determined by ultraviolet absorption after recovery.

The pET-44a (Novagen) plasmid was digested with BoxI (Thermo Fisher Scientific, Shanghai, China) at 37° C. for 1 hour, and then heated to 65° C. to inactivate BoxI. The OsHPPD DNA fragment was mixed with BoxI linearized pET-44a vector in equal amounts, to which an equal volume of 2× Gibson Assembly Master Mix (Hanbio Biotechnology Co., Ltd., Shanghai, China) was added, mixed, and incubated at 50° C. for one hour; 5 µl of the ligation product was used to transform the competent *E. coli* DH5a, and the bacterial solution was applied to the surface of an LB solid medium plate containing 100 ppm of ampicillin, and cultured overnight at 37° C. On the next day, after correct clones were confirmed by individual bacterial colonies PCR, three correct clones were cultured overnight at 37° C., and sufficient plasmid DNA was extracted and sent to Qingke Biotechnology Co., Ltd. (Beijing, China) for sequencing by Sanger sequencing method. The sequencing results confirmed that the correct full-length rice HPPD coding region DNA was obtained.

Figure 1:
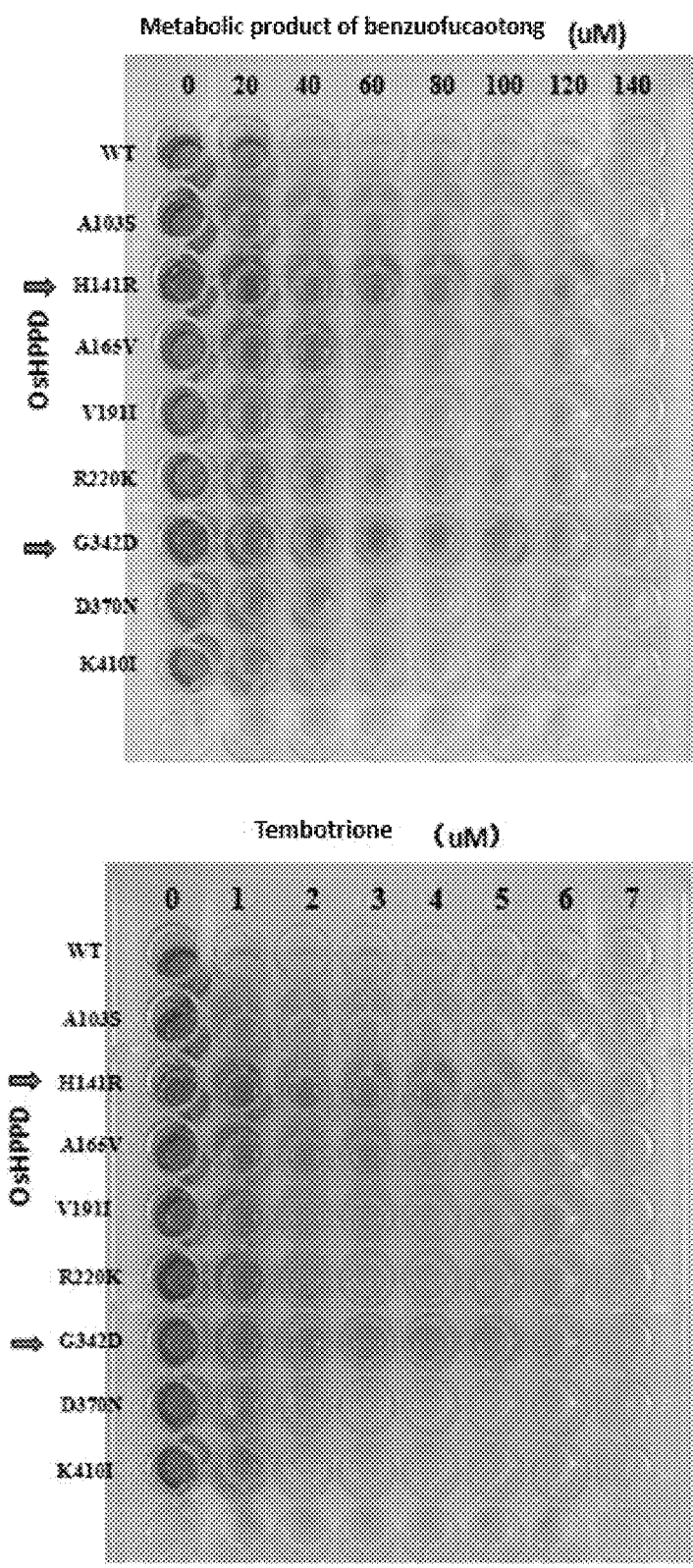

Example 2 Saturated Random Mutation of Each Amino Acid in Rice HPPD (OsHPPD) Protein The rice full-length OsHPPD enzyme has 446 amino acids and its amino acid sequence is set forth in SEQ ID NO: 2, wherein the amino acids 1-50 are considered to constitute a signal peptide which is responsible for directing into chloroplast (Siehl et al. Plant Physiol. 2014 November; 166(3): 1162-1176). Therefore, from the amino acid at the 51-position to the amino acid at the 466-position, a saturated random mutation was made for each amino acid. This was achieved by performing a bridge PCR by using a primer containing a coding sequence of an amino acid to be mutated into NNK and another suitable conventional primer. In NNK, N represented A/T/G/C and K represented G/T, and the NNK codon could encode any one of 20 amino acids or terminators. Accordingly, this was a saturated mutation. Please see: Kille S. Acevedo-Rocha C G, Parra L P, Zhang Z G, Opperman D J, Reetz M T, Acevedo J P (2013) Reducing codon redundancy and screening effort of combinatorial protein libraries created by saturation mutagenesis. ACS Synth Biol 2(2):83-92; Directed Evolution Library Creation: methods and protocols 2nd ed. Edited by Elizabeth M. J. Gillam, Janine N. Copp and David F. Ackerley New York, NY United States: Springer, 2014. doi:10.1007/978-1-4939-1053-3. A large number of mutants would be produced. The mutant was cloned into a linearized pET-44a vector and transformed into E. co/i, which was cultivated by using a 96-well plate in a 2×YT culture solution containing an HPPD-inhibiting herbicide (such as 1-2 µM tembotrione) and a substrate tyrosine (1 g/L) in a shaker at 28° C. and 150 rpm for 24 hours for expression, and then the mutants were rapidly screened out according to their color browning. By using the method, 10 single amino acid mutants, A103S, H141R, H141 K, H141T, A165V, V191I, R220K, G342D, D370N and K410I, were screened out. The color reaction of these resistant mutants in the presence of tembotrione and the metabolic product of benzuofucaotong relative to that of the wild type was as shown in FIG. 1. Among them, the color changes of H141R and G342D were the most significant and were obviously deeper than that of the wild type.

The method of the present patent enhanced the solubility of HPPD expressed in bacteria by fusing NusA with the rice HPPD protein, whereby the protein could be expressed and the enzymatic reaction could be performed simultaneously at 28° C., greatly saving screening time and steps.

Similarly, the color reaction of these mutants in the presence of the other three HPPD-inhibiting herbicides huanbifucaotong, topramezone and mesotrione were determined, see FIGS. 2 and 3. The resistance/tolerance of each of the mutants to the five herbicides was roughly estimated on the basis of color changes thereof and the results were shown in Table 1. The more the plus sign "+", the deeper the color and the higher the resistance/tolerance as compared to the wild type.

TABLE 1

Single-site mutants of Rice HPPD and the relative resistance thereof to 5 different HPPD-inhibiting herbicides

| Site | Wild-type amino acid residue | Mutant amino acid residue | Tembotrione | Benzuofucaotong metabolic product | Huanbifucaotong | Topramezone | Mesotrione |
|---|---|---|---|---|---|---|---|
| Wild-type | – | – | + | + | + | + | + |
| 103 | A | S | 2+ | 2+ | + | 2+ | 3+ |
| 141 | H | R; K; T | 141R: 6+ | 141R: 6+ | 141R: 6+ | 141R: 2+ | 141R: 5+ |
| 165 | A | V | 3+ | 3+ | 5+ | 2+ | 5+ |
| 191 | V | I | 2+ | 2+ | 3+ | 2+ | 4+ |
| 220 | R | K | 2+ | 2+ | 3+ | 2+ | 4+ |
| 342 | G | D | 6+ | 6+ | 3+ | 2+ | 2+ |
| 370 | D | N | 2+ | 2+ | 3+ | 2+ | 2+ |
| 410 | K | I | 2+ | 2+ | 2+ | 2+ | 1+ |

The entire process was illustrated by the production and screening of the H141R mutant as an example.

1. A PCR amplification was carried out by using the NusOsF and OsHPPD-H141R-R: CACCGCGAGGCCGTGGTCC as primers, the synthesized full-length OsHPPD template and Q5 DNA polymerase (NEB, New England Biolabs, Boston, USA) to obtain a former fragment DNA. The amplification was carried out under the conditions are: 98° C./2 minutes: 98° C./20 seconds→65° C./30 seconds→72° C./60 seconds (35 cycles); and 72° C./2 seconds. After detection by agarose gel electrophoresis, the bands with correct size were recovered and the concentrations were determined by ultraviolet absorption. Similarly, A PCR amplification was carried out by the NusOsR and OsHPPD-H141R-F: CACGGCCTCGCGGTGNNKGCCGTGGCGC TGCGCG as primers, the synthesized full-length OsHPPD template and Q5 DNA polymerase (NEB, New England Biolabs, Boston, USA) to obtain a latter DNA fragment.

2. The former fragment and the latter fragment has 19 overlapped bases in the middle (OsHPPD-H141R-F and OsHPPD-H141R-R). Accordingly, the two fragments were mixed in equimolar amounts, and an equal volume of 2× Glodstar MasterMix (CornWin Biotechnology Co., Ltd., Beijing) was added thereto, and 10 μmol of NusOsF and NusOsR as primers were added thereto to perform a bridge PCR reaction. The amplification was carried out under conditions: 96° C. for 2 minutes; 96° C. for 20 seconds, 65° C. for 30 seconds, and 72° C. for 60 seconds (30 cycles); and 72° C. for 5 minutes. After detection by agarose gel electrophoresis, the bands with correct size (1.3 Kb) were recovered and the concentrations were determined by ultraviolet absorption.

3. The OsHPPDMut DNA fragment was mixed with the above linearized pET-44a vector in equal amounts, to which an equal volume of 2× Gibson Assembly Master Mix (Hanbio Biotechnology Co., Ltd.) was added, and incubated at 50° C. for one hour: 5 μl of the ligation product was used to transform the competent *E. coli* DH5a, and the bacterial solution was applied to the surface of an LB solid medium plate containing 100 ppm of ampicillin, and cultured overnight at 37° C. All the clones (colonies) on the plate were scrapped, plasmids were extracted, and the DNAs were quantified by UV absorption. 100 ng of plasmids were transformed into competent BL21 (DE3), a plate was coated, and the cultivation was performed overnight at 37° C. The plate with the transformed *E. coli* was temporarily stored at 4° C. for screening mutants.

4. Screening of mutants resistant to HPPD-inhibiting herbicides by color reaction HPPD-inhibiting herbicides inhibited HPPD enzymatic activity. When tyrosine was converted to 4-hydroxyphenylpyruvate (HPP) under the action of tyrosine transaminase, the inactivated HPPD was unable to oxidize 4-hydroxyphenylpyruvate into homogentisic acid (HGA). HGA was dark brown. Therefore, if an HPPD mutant was resistant to or tolerant to an herbicide, after expressed in *E. coli*, the mutant could also oxidize 4-hydroxyphenylpyruvate into homogentisic acid, whereby dark brown appeared. Therefore, *E. coli* was cultured in a 2×YT culture medium containing a HPPD-inhibiting herbicide and a substrate tyrosine using a 96-well plate to express HPPD, and these mutants were rapidly screened according to their color changes.

(1) Preparation of 2×YT culture medium (1 g/L L-Tyr, 0.1 mM IPTG, 0.01 mM $MnCl_2$ and 100 mg/L ampicillin were added).

(2) 0.1 mL of the above medium was added to each well of a 96-well plate, and the expression clones of OsHPPD wild type or mutant (OsHPPD Mut) from the *E. coli* plate obtained by the above transformation were subjected to liquid culture in the 96-well plate. HPPD inhibitors having a final concentration of 1 μM-20 μM were added according to different selected agents, for example, the final concentration of tembotrione was 1.7 μM while mesotrione was 10 μM. After all components were added, a strong gas-permeable sealing film was applied as a cover (Suolaibao Biological Agent Company, Beijing, China).

(3) The 96-well plate was incubated on a shaker at 28° C. and 150 rpm for 24 hours. The light absorption at 400 nm of the culture was visualized or detected, and the clones that significantly produce black pigments were picked by using an inoculating loop, and further cultured. The plasmid DNA was extracted, sequenced and for further studies, such as expression, purification and enzyme activity assay of the OsHPPD protein.

The single-site mutants A103S, A165V, V191I, R220K, D370N, K410I and three-site mutant H141R/G342D/D370N were obtained with the primers shown inn Table 2 by using the same method, respectively.

TABLE 2

Primers used in the preparation of HPPD mutants

| Name of the primer | Sequence of the primer (5'-3') |
|---|---|
| NusOsF | acg att gat gac gac gac aag ATGCCTCCCACTCCCACCCC |
| NusOsR | tccacgagctcccggactcTTA CTAGGATCCTTGAACTGTAG |
| OsHPPD-H141R-F | CACGGCCTCGCGGTGNNKGCCGTGGCGCTGCGCG |
| OsHPPD-H141R-R | CACCGCGAGGCCGTGGTCC |
| OsHPPD-A103S-F | GCGTTCCTCTTCACCNNKCCCTACGGGGCGACCACG |
| OsHPPD-A103S-R | GGTGAAGAGGAACGCGACGGAGGC |
| OsHPPD-A165V-F | TCGCGGCCGGTGCGCGCCCGNNKTTCCAGCCCG |
| OsHPPD-A165V-R | CGGGCGCGCACCGGCCGCGAC |
| OsHPPD-V191I-F | GTCGTGCTCCGCTTCNNKAGCCACCCGG |
| OsHPPD-V191I-R | GAAGCGGAGCACGACGTCGCC |
| OsHPPD-R220K-F | CGCCGTGGACTACGGCCTCCGCNNKTTCGACCACG |
| OsHPPD-R220K-R | GCGGAGGCCGTAGTCCACGGCGC |
| OsHPPD-D370N-F | CTCGTGGACAGGGATNNKCAGGGGGTGTTGCTCCAGATCT |
| OsHPPD-D370N-R | ATCCCTGTCCACGAGCACCCC |
| OsHPPD-K410I-F | TGGGCAGGAGTACCAGNNKGGCGGCTGCGGCG |
| OsHPPD-K410I-R | CTGGTACTCCTGCCCACTCTCATCC |
| OsHPPD-H141R/G342D/D370N-F | GGCCTCAACTCGGTGGTGCTCG |
| OsHPPD-H141R/G342D/D370N-R | GCGAGCACCACCGAGTTGAGGC |

In addition, some two-site mutants involving a combination of single-site mutations, such as H141R/G342D, H141R/D370N and G342D/D370N, were also prepared by a method similar to bridge PCR.

Example 3 Combinations of Multi-Site Mutations of Rice HPPD (OsHPPD) Proteins

The present invention also tested the color reaction of the H141R, G342D, D370N as well as mutant HPPD proteins comprising a combination thereof to five different HPPD-inhibiting herbicides, e.g., tembotrione, a metabolic product of benzuofucaotong, huanbifucaotong, topramezone and mesotrione at different time and on different 96-well plates. The test results were shown in FIGS. 4, 5 and 6. Table 3 showed the resistance/tolerance of these mutants to corresponding herbicides estimated according to their color shades. It could be seen from the Table 3 that the two-site mutants and three-site mutants also had high herbicide tolerance, proving that combinations of amino acid mutations could be present in rice HPPD (OsHPPD) protein in combinations, which also provide high resistance and/tolerance to HPPD-inhibiting herbicides.

TABLE 3

Resistance of single-site and multi-site mutant rice HPPDs to 5 herbicides metabolic product

| Complex sites | Tembotrione | Benzucfucaotong metabolic product | Huanbifucaotong | Topramezone | Mesotrione |
|---|---|---|---|---|---|
| Wild type (WT) | + | + | + | + | + |
| H141R | 2+ | 5+ | 20+ | 15+ | 20+ |
| G342D | 3+ | 5+ | 10+ | 7+ | 20+ |
| D370N | 1.5+ | 2+ | 5+ | 5+ | 5+ |
| H141R/G342D | 10+ | 10+ | 30+ | 25+ | 30+ |
| H141R/D370N | 3+ | 4+ | 20+ | 20+ | 10+ |

TABLE 3-continued

Resistance of single-site and multi-site mutant rice HPPDs to 5 herbicides metabolic product

| Complex sites | Tembotrione metabolic product | Benzucfucaotong metabolic product | Huanbifucaotong | Topramezone | Mesotrione |
|---|---|---|---|---|---|
| G342D/D370N | 2+ | 4+ | 5+ | 5+ | 6+ |
| H141R/G342D/D370N | 10+ | 10+ | 30+ | 30+ | 30+ |

Example 4 Further Saturation Mutation on the Basis of the Three-Site Mutant H141R-G342D-D370N 1. In the color reaction of the three-site mutant OsHPPD H141R-G342D-D370N expressed in E. Coll, when the shuangzuocaotong (code 101) was used for the inhibition, a concentration of 120 μM was required to have no significant color reaction. Therefore, 120 μM of the compound 101 was chosen for initial screening. By using the aforementioned technical route, a pair of primers were designed for each amino acid at the 51-446 amino acid positions (except for 141R, 342D, and 370N sites), respectively, and one of which was represented by NNK at the amino acid site to be subjected to saturation mutation. A series of mutants were produced by PCR amplification, then expressed in E. coli BL21 (DE3), and repeatedly screened with 120 μM of the compound 101. After all single-site mutations were screened, 18 new mutation sites were obtained. The new sites were: R93S, G226H, L276W, P277N, P336D, P337A, N338D, N338S, N338Y, R346C, R346D, R346H, R346S, R346Y, I377C, P386T, L390I, M392L, E403G, K418P, G419F, G419L, G419V, N420S, N420T, E430G, Y431 L. Amino acid changes and nucleotides (bases) for these new mutation sites as well as the primers used to produce these new mutation sites were listed in Table 4, and the sequences of the primers were listed in Table 5. To sum up, as shown in FIG. 7, totally 26 mutation sites were obtained by screening, wherein, one original amino acid at some of the sites could be changed to several different amino acids, for example, H141R,K,T; N338D,S,Y; R346C,D,H,S,Y; G419F,L,V and N420S, T.

TABLE 4

All newly screened mutation sites, amino acid and base changes and primers used

| Site | WT Amino acid | Base | Mutation Amino acid | Base | Primer |
|---|---|---|---|---|---|
| 93 | R | CGC | S | TCC | 93F 93R |
| 226 | G | GGC | H | CAC | 226F 226R |
| 276 | L | CTG | W | TGG | 276F 276R |
| 277 | P | CCG | N | AAT | 277F 277R |
| 336 | P | CCG | D | GAT | 336F 336R |
| 337 | P | CCC | A | GCC | 337F 337R |
| 338 | N | AAC | D, S, Y | GAC, AGC, TAC | 338F 338R |
| 346 | R | CGC | C, H, S, D, Y | TGC, CAC, AGC, GAC, TAT | 346F 346R |
| 377 | I | ATC | C | TGC | 377F 377R |
| 386 | P | CCA | T | ACA | 386F 386R |
| 390 | L | TTG | I | ATT | 390F 390R |
| 392 | M | ATG | L | CTG | 392F 392R |
| 403 | E | GAG | G | GGG | 403F 403R |
| 418 | K | AAG | P | CCG | 418F 418R |
| 419 | G | GGC | F, L, V | TTC, TTG, GTG | 419F 419R |
| 420 | N | AAC | S, T | AGC, ACC | 420F 420R |
| 430 | E | GAG | G | GGG | 430F 430R |
| 431 | Y | TAT | L | CTG | 431F 431R |

TABLE 5

All newly screened mutation sites and primer sequences used

| Amino acid position | Primer and the sequence (5'→3') |
|---|---|
| 93 | 93-F: CGCACGCCTCCCTCCTCCTCNNKTCCGCCTCCGTCGCGTTCCTC<br>93-R: GAGGAGGAGGGAGGCGTGCG |
| 226 | 226-F: GCCGGTTCGACCACGTCGTCNNKAACGTGCCGG<br>226-R: GACGACGTGGTCGAACCGGC |
| 276 | 276-F: ACAACGCGGAGACCGTGCTGNNKCCGCTCAACG<br>276-R: CAGCACGGTCTCCGCGTTGT |
| 277 | 277-F: ACGCGGAGACCGTGCTGCTGNNKCTCAACGAGCCGGTGCACGG<br>277-R: CAGCAGCACGGTCTCCGCGTTG |
| 336 | 336-F: TCGAGTTCTTGGCGCCGCCGNNKCCCAACTACTACGACGGCGTG<br>336-R: CGGCGGCGCCAAGAACTCGAAG |
| 337 | 337-F: AGTTCTTGGCGCCGCCGCCGNNKAACTACTACGACGGCGTGCG<br>337-R: CGGCGGCGGCGCCAAGAACTC |
| 338 | 338-F: TCTTGGCGCCGCCGCCGCCCNNKTACTACGACGGCGTGCGGCG<br>338-R: GGGCGGCGGCGGCGCCAAGAAC |
| 346 | 346-F: ACTACGACGGCGTGCGGCGGNNKGCCGGGGACGTGCTCTCGGAG<br>346-R: CCGCCGCACGCCGTCGTAGTAG |
| 377 | 377-F: ACCAGGGGGTGTTGCTCCAGNNKTTCACCAAGC<br>377-R: CTGGAGCAACACCCCCTGGT |
| 386 | 386-F: CCAAGCCAGTAGGAGACAGGNNKACCTTTTTCTTGGAGATGATAC<br>386-R: CCTGTCTCCTACTGGCTTGG |
| 390 | 390-F: GAGACAGGCCAACCTTTTTCNNKGAGATGATAC<br>390-R: GAAAAAGGTTGGCCTGTCTC |
| 392 | 392-F: AGGCCAACCTTTTTCTTGGAGNNKATACAAAGGA<br>392-R: CTCCAAGAAAAAGGTTGGCCTG |
| 403 | 403-F: TTGGGTGCATGGAGAAGGATNNKAGTGGGCAGGAGTACCAGAAG<br>403-R: ATCCTTCTCCATGCACCCAATC |
| 418 | 418-F: GCGGCTGCGGCGGGTTTGGGNNKGGCAACTTCTCGGAGCTGTTC<br>418-R: CCCAAACCCGCCGCAGCCGC |
| 419 | 419-F: GGCTGCGGCGGGTTTGGGAAGNNKAACTTCTCGGAGCTGTTCAAG<br>419-R: CTTCCCAAACCCGCCGCAGCC |
| 420 | 420-F: GCGGCGGGTTTGGGAAGGGCNNKTTCTCGGAGCTGTTCAAGTC<br>420-R: GCCCTTCCCAAACCCGCCGC |
| 430 | 430-F: AGCTGTTCAAGTCCATTGAGNNKTATGAGAAATCCCTTGAAGC<br>430-R: CTCAATGGACTTGAACAGCTC |
| 431 | 431-F: TGTTCAAGTCCATTGAGGAGNNKGAGAAATCCCTTGAAGCCAAG<br>431-R: CTCCTCAATGGACTTGAACAG |

Example 5 Combinations of Mutation Sites

The mutation sites were combined on the basis of the following three principles: the sites were close to facilitate homologous replacement in gene editing, and the editing efficiency was high; the base change was the same as A→G/T→C or C→T/G→A to facilitate base editing; and resistant sites were as small as possible to facilitate editing and avoiding possible negative effects. According to the above principles, the combinations, corresponding primers and prokaryotic expression vectors were designed, and then screened by color reactions to find a highly resistant combination suitable for editing to perform gene editing.

(1) A total of 33 combinations were designed according to the principle of close distance, of which 24 combinations had 3 mutation sites and 9 combinations had 4 mutation sites. Table 6 showed these combinations and the primer sequences used.

TABLE 6

Combinations of mutation sites (3 or 4 mutation sites) designed under the principle of close distance

| Combinations of 3/4 mutation sites | Primers and sequences (5'→3') |
|---|---|
| P336D/N338D/G342D | 1-336D-F1: TCGAGTTCTTGGCGCCGCCGGATCCCGACTACTACGACGACG<br>1-336D-R1: CGGCGGCGCCAAGAACTCG |
| P336D/N338S/G342D | 1-338S-F1: TCTTGGCGCCGCCGGATCCCAGCTACTACGACGACGTGCGGCG<br>1-338S-R1: GGGATCCGGCGGCGCCAAG |
| P336D/N338Y/G342D | 1-338Y-F2: TCTTGGCGCCGCCGGATCCCTACTACTACGACGACGTGCGGCG<br>1-338S-R1: GGGATCCGGCGGCGCCAAG |
| N338D/G342D/R346C | 346-F-2: CTACGACGACGTGCGGCGGTGCGCCGGGGACGTGCTCTCG<br>346-R-2: CCGCCGCACGTCGTCGTAG |
| N338D/G342D/R346H | 346-F-3: CTACGACGACGTGCGGCGGCACGCCGGGGACGTGCTCTCG<br>346-R-2: CCGCCGCACGTCGTCGTAG |
| N338D/G342D/R346S | 1-346S-F1: CTACGACGACGTGCGGCGGAGCGCCGGGGACGTGCTCTCG<br>346-R-2: CCGCCGCACGTCGTCGTAG |
| N338S/G342D/R346C | 2-338S-F1: CTTGGCGCCGCCGCCGCCCAGCTACTACGACGACGTGCGGC<br>2-338S-R1: GGGGGGGGGGGGCGCCAAG |
| N338S/G342D/R346H | 2-338S-F1: CTTGGCGCCGCCGCCGCCCAGCTACTACGACGACGTGCGGC<br>2-338S-R1: GGGGGGGGGGGGCGCCAAG |
| N338S/G342D/R346S | 2-338S-F1: CTTGGCGCCGCCGCCGCCCAGCTACTACGACGACGTGCGGC<br>2-338S-R1: GGGGGGGGGGGGCGCCAAG |
| N338Y/G342D/R346C | 2-338Y-F2: CTTGGCGCCGCCGCCGCCCTACTACTACGACGACGTGCGGC<br>2-338S-R1: GGGCGGCGGCGGCGCCAAG |
| N338Y/G342D/R346H | 2-338Y-F2: CTTGGCGCCGCCGCCGCCCTACTACTACGACGACGTGCGGC<br>2-338S-R1: GGGCGGCGGCGGCGCCAAG |
| N338Y/G342D/R346S | 2-338Y-F2: CTTGGCGCCGCCGCCGCCCTACTACTACGACGACGTGCGGC<br>2-338S-R1: GGGGGGGGGGGGCGCCAAG |
| P336D/G342D/R346C | 2-336D-F1: TCGAGTTCTTGGCGCCGCCGGATCCCAACTACTACGACGAC<br>1-336D-R1: CGGCGGCGCCAAGAACTCG |
| P336D/G342D/R346H | 2-336D-F1: TCGAGTTCTTGGCGCCGCCGGATCCCAACTACTACGACGAC<br>1-336D-R1: CGGCGGCGCCAAGAACTCG |
| P336D/G342D/R346S | 2-336D-F1: TCGAGTTCTTGGCGCCGCCGGATCCCAACTACTACGACGAC<br>1-336D-R1: CGGCGGCGCCAAGAACTCG |
| P336D/N338D/R346C | 2-346C-F2: CTACGACGGCGTGCGGCGGTGCGCCGGGGACGTGCTCTCGG<br>2-346C-R2: CCGCCGCACGCCGTCGTAG |
| P336D/N338D/R346H | 2-346H-F2: ACTACGACGGCGTGCGGCGGCACGCCGGGGACGTGCTCTCGG<br>2-346C-R2: CCGCCGCACGCCGTCGTAG |

TABLE 6-continued

Combinations of mutation sites (3 or 4 mutation sites) designed under the principle of close distance

| Combinations of 3/4 mutation sites | Primers and sequences (5'→3') |
| --- | --- |
| P336D/N338D/R346S | 2-346S-F2:<br>ACTACGACGGCGTGCGGCGGAGCGCCGGGGACGTGCTCTCGG<br>2-346C-R2: CCGCCGCACGCCGTCGTAG |
| P336D/N338S/R346C | 2-346C-F2:<br>CTACGACGGCGTGCGGCGGTGCGCCGGGGACGTGCTCTCGG<br>2-346C-R2: CCGCCGCACGCCGTCGTAG |
| P336D/N338S/R346H | 2-346H-F2:<br>ACTACGACGGCGTGCGGCGGCACGCCGGGGACGTGCTCTCGG<br>2-346C-R2: CCGCCGCACGCCGTCGTAG |
| P336D/N338S/R346S | 2-346S-F2:<br>ACTACGACGGCGTGCGGCGGAGCGCCGGGGACGTGCTCTCGG<br>2-346C-R2: CCGCCGCACGCCGTCGTAG |
| P336D/N338Y/R346C | 2-346C-F2:<br>CTACGACGGCGTGCGGCGGTGCGCCGGGGACGTGCTCTCGG<br>2-346C-R2: CCGCCGCACGCCGTCGTAG |
| P336D/N338Y/R346H | 2-346H-F2:<br>ACTACGACGGCGTGCGGCGGCACGCCGGGGACGTGCTCTGG<br>2-346C-R2: CCGCCGCACGCCGTCGTAG |
| P336D/N338Y/R346S | 2-346S-F2:<br>ACTACGACGGCGTGCGGCGGAGCGCCGGGGACGTGCTCTCGG<br>2-346C-R2: CCGCCGCACGCCGTCGTAG |
| P336D/N338D/G342D/R346C | 1-336D-F1: TCGAGTTCTTGGCGCCGCCGGATCCCGACTACTACGACGACG<br>1-336D-R1: CGGCGGCGCCAAGAACTCG |
| P336D/N338D/G342D/R346H | 1-336D-F1:<br>TCGAGTTCTTGGCGCCGCCGGATCCCGACTACTACGACGACG<br>1-336D-R1: CGGCGGCGCCAAGAACTCG |
| P336D/N338D/G342D/R346S | 1-336D-F1:<br>TCGAGTTCTTGGCGCCGCCGGATCCCGACTACTACGACGACG<br>1-336D-R1: CGGCGGCGCCAAGAACTCG |
| P336D/N338S/G342D/R346C | 2-336D-F2:<br>TCGAGTTCTTGGCGCCGCCGGATCCCAGCTACTACGACGACG<br>1-336D-R1: CGGCGGCGCCAAGAACTCG |
| P336D/N338S/G342D/R346H | 2-336D-F2:<br>TCGAGTTCTTGGCGCCGCCGGATCCCAGCTACTACGACGACG<br>1-336D-R1: CGGCGGCGCCAAGAACTCG |
| P336D/N338S/G342D/R346S | 2-336D-F2:<br>TCGAGTTCTTGGCGCCGCCGGATCCCAGCTACTACGACGACG<br>1-336D-R1: CGGCGGCGCCAAGAACTCG |
| P336D/N338Y/G342D/R346C | 3-336D-F3:<br>TCGAGTTCTTGGCGCCGCCGGATCCCTACTACTACGACGACG<br>1-336D-R1: CGGCGGCGCCAAGAACTCG |
| P336D/N338Y/G342D/R346H | 3-336D-F3:<br>TCGAGTTCTTGGCGCCGCCGGATCCCTACTACTACGACGACG<br>1-336D-R1: CGGCGGCGCCAAGAACTCG |
| P336D/N338Y/G342D/R346S | 3-336D-F3:<br>TCGAGTTCTTGGCGCCGCCGGATCCCTACTACTACGACGACG<br>1-336D-R1: CGGCGGCGCCAAGAACTCG |

As shown in FIG. 8, various combinations of these close mutation sites were cloned, expressed and compared by color reactions, and it was found that the three combinations with the mutation sites of N338D/G342D/R346C, N338D/G342D/R346H and N338S/G342D/R346C, respectively, had the highest resistance and they still showed significant color reactions in the presence of 1000-1500 μM the metabolic product 101 of shuangzuocaotong, and followed by the two combinations with four close mutation sites P336D/N338D/G342D/R346C and P336D/N338D/G342D/R346H, respectively.

(2) Six combinations were designed according to the principle for facilitating base editing, i.e., the H141R/N338D/N420S, H141R/N338S/N420S, H141R/N338D and H141R/N420S corresponding to the same A→G/T→C, and G342D/R346C and G342D/R346H corresponding to the same C→T/G→A. The primers for producing these combinations and sequences thereof were listed in Table 7.

TABLE 7

Combinations of mutation sites designed according to the principle for facilitating base editing

| Combinations of mutation sites | Primers and sequences (5'→3') |
|---|---|
| H141R/N338D/N420S | 420-AGC-F: GCGGCGGGTTTGGGAAGGGCAGCTTCTCGGAGCTGTTCAAGTC<br>420-R: GCCCTTCCCAAACCCGCCGC |
| H141R/N338S/N420S | 338-AGC-F: TCTTGGCGCCGCCGCCGCCCAGCTACTACGACGGCGTGCGGCG<br>338-R: GGGGGGGGGGGGCGCCAAGAAC |
| H141R/N338D | 338-GAC-F: TCTTGGCGCCGCCGCCGCCCGACTACTACGACGGCGTGCGGCG<br>338-R: GGGGGGGGGGGGCGCCAAGAAC |
| H141R/N420S | 420-AGC-F: GCGGGGGGTTTGGGAAGGGCAGCTTCTCGGAGCTGTTCAAGTC<br>420-R: GCCCTTCCCAAACCCGCCGC |
| G342D/R346C | 346-F-2: CTACGACGACGTGCGGCGGTGCGCCGGGGACGTGCTCTCG<br>346-R-2: CCGCCGCACGTCGTCGTAG |
| G342D/R346H | 346-F-3: CTACGACGACGTGCGGCGGCACGCCGGGGACGTGCTCTCG<br>346-R-2: CCGCCGCACGTCGTCGTAG |

(3) Other combinations were shown in the Table 8.

TABLE 8

Combinations of two, three, four or more mutation sites

| Combinations of mutation sites | Primers and sequences (5'→3') |
|---|---|
| H141R/N338D | 338-GAC-F: TCTTGGCGCCGCCGCCGCCCGACTACTACGACGGCGTGCGGCG<br>338-R: GGGCGGCGGCGGCGCCAAGAAC |
| H141R/G342D | 342-GAC-F: CGCCGCCCAACTACTACGACGACGTGCGGCGGCGCGCCGGGGAC<br>342-R: GTCGTAGTAGTTGGGCGGCG |
| N338D/G342D | 338-GAC-342-GAC-F: TCTTGGCGCCGCCGCCGCCCGACTACTACGACGACGTGCGGCG<br>338-R: GGGCGGCGGCGGCGCCAAGAAC |
| K418P/G419F | 418-CCG-419-TTC-F: CGGCTGCGGGGGGTTTGGGCCGTTCAACTTCTCGGAGCTGTTCAAG<br>418-R: CCCAAACCCGCCGCAGCCGC |
| G419F/N420S | 419-TTC-420-TCG-F: GCGGCGGGTTTGGGAAGTTCTCGTTCTCGGAGCTGTTCAAG<br>419-TTC-420-TCG-R: GAACTTCCCAAACCCGCCGC |
| G342D/R346C | 346-F-2: CTACGACGACGTGCGGCGGTGCGCCGGGGACGTGCTCTCG<br>346-R-2: CCGCCGCACGTCGTCGTAG |
| G342D/R346H | 346-F-3: CTACGACGACGTGCGGCGGCACGCCGGGGACGTGCTCTCG<br>346-R-2: CCGCCGCACGTCGTCGTAG |
| H141R/N420S | 420-AGC-F: GCGGCGGGTTTGGGAAGGGCAGCTTCTCGGAGCTGTTCAAGTC<br>420-R: GCCCTTCCCAAACCCGCCGC |
| G338D/K418P | 418-CCG-F: GCGGCTGCGGCGGGTTTGGGCCGGGCAACTTCTCGGAGCTGTTC<br>418-R: CCCAAACCCGCCGCAGCCGC |

TABLE 8-continued

Combinations of two, three, four or more mutation sites

| Combinations of mutation sites | Primers and sequences (5'→3') |
|---|---|
| P277N/N338D | 277-AAT-F: GCGGAGACCGTGCTGCTGAATCTCAACGAGCCGGTGCACG<br>277-R: CAGCAGCACGGTCTCCGCGTTGTTG |
| L276W/P277N | 276-TGG-F: CAACGCGGAGACCGTGCTGTGGCCGCTCAACGAGCCGGTGC<br>276-R: CAGCACGGTCTCCGCGTTGTTGGCG |
| H141R/N338D/<br>G342D | 338-GAC-342-GAC-F: TCTTGGCGCCGCCGCCGCCCGACTACTACGACGACGTGC<br>GGCG<br>338-R: GGGCGGCGGCGGCGCCAAGAAC |
| H141R/G342D/<br>K418P | 418-CCG-F: GCGGCTGCGGCGGGTTTGGGCCGGGCAACTTCTCGGAGCTGTTC<br>418-R: CCCAAACCCGCCGCAGCCGC |
| H141R/G342D/<br>G419F | 419-TTC-F: GCTGCGGCGGGTTTGGGAAGTTCAACTTCTCGGAGCTGTTCAAG<br>419-R: CTTCCCAAACCCGCCGCAGC |
| H141R/G342D/<br>P386T | 338-AAC-F: TCTTGGCGCCGCCGCCGCCCAACTACTACGACGGCGTGCGGCG<br>338-R: GGGGGGGGGGGGCGCCAAGAAC |
| K418P/G419F/<br>N420T | 418-419-420-ACT-F:<br>GCGGCGGGTTTGGGCCGTTCACTTTCTCGGAGCTGTTCAAGTC<br>418-419-420-R: GAACGGCCCAAACCCGCCGC |
| K418T/G419F/<br>N420T | 418-419-420-ACT-F:<br>GCGGCGGGTTTGGGCCGTTCACTTTCTCGGAGCTGTTCAAGTC<br>418-419-420-R: GAACGGCCCAAACCCGCCGC |
| H141R/G342D/<br>R346C | 346-F-2: CTACGACGACGTGCGGCGGTGCGCCGGGGACGTGCTCTCG<br>346-R-2: CCGCCGCACGTCGTCGTAG |
| H141R/G342D/<br>R346H | 346-F-3: CTACGACGACGTGCGGCGGCACGCCGGGGACGTGCTCTCG<br>346-R-2: CCGCCGCACGTCGTCGTAG |
| H141R/G342D/<br>N420S | 420-AGC-F: GCGGCGGGTTTGGGAAGGGCAGCTTCTCGGAGCTGTTCAAGTC<br>420-R: GCCCTTCCCAAACCCGCCGC |
| H141R/G342D/<br>P277N | 277-AAT-FGCGGAGACCGTGCTGCTGAATCTCAACGAGCCGGTGCACG<br>277-R: CAGCAGCACGGTCTCCGCGTTGTTG |
| H141R/G342D/<br>P336D | 336-GAC-F: GAGTTCTTGGCGCCGCCGGATCCCAACTACTACGACGACG<br>336-R: CGGCGGCGCCAAGAACTCGAAGCCGC |
| H141R/G342D/<br>L276W | 276-TGG-F: CAACGCGGAGACCGTGCTGTGGCCGCTCAACGAGCCGGTGC<br>276-R: CAGCACGGTCTCCGCGTTGTTGGCG |
| H141R/G342D/<br>R346S | 346-AGC-F: CTACGACGACGTGCGGCGGAGTGCCGGGGACGTGCTCTC<br>346-R: CCGCCGCACGTCGTCGTAGTAG |
| H141R/G342D/<br>L3901 | 390-ATT-F: GAGACAGGCCAACCTTTTTCATTGAGATGATACAAAGGATTGG<br>390-R: GAAAAAGGTTGGCCTGTCTC |
| H141R/G342D/<br>I377C | 377-TGT-F: ACCAGGGGTGTTGCTCCAGTGTTTCACCAAGCCAGTAGGAGAC<br>377-R: CTGGAGCAACACCCCTGGTC |
| H141R/G342D/<br>M392L | 392-CTG-F: GGCCAACCTTTTTCTTGGAGCTGATACAAAGGATTGGGTGCATG<br>392-R: CTCCAAGAAAAAGGTTGGCC |
| H141R/P337A/<br>G342D | 337-GCC-F: AGTTCTTGGCGCCGCCGCCGGCCAACTACTACGACGACGTGCG<br>337-R: CGGCGGCGGCGCCAAGAACTC |
| H141R/N338S/<br>G342D | 338-AGC-F: TCTTGGCGCCGCCGCCGCCCAGCTACTACGACGGCGTGCGGCG<br>338-R: GGGCGGCGGCGGCGCCAAGAAC |
| H141R/N338Y/<br>G342D | 338-TAC-F: CTTGGCGCCGCCGCCGCCCTACTACTACGACGACGTGCG<br>338-R: GGGGGGGGGGGCGCCAAGAACTCG |
| P277N/N338D/<br>G342D | 277-AAT-F: GCGGAGACCGTGCTGCTGAATCTCAACGAGCCGGTGCACG<br>277-R: CAGCAGCACGGTCTCCGCGTTGTTG |
| P277N/G342D/<br>R346C | 277-AAT-F: GCGGAGACCGTGCTGCTGAATCTCAACGAGCCGGTGCACG<br>277-R: CAGCAGCACGGTCTCCGCGTTGTTG |
| P277N/N338D/<br>N420S | 277-AAT-F: GCGGAGACCGTGCTGCTGAATCTCAACGAGCCGGTGCACG<br>277-R: CAGCAGCACGGTCTCCGCGTTGTTG |

TABLE 8-continued

Combinations of two, three, four or more mutation sites

| Combinations of mutation sites | Primers and sequences (5'→3') |
|---|---|
| N338D/G342D/ K418P | 418-CCG-F: GCGGCTGCGGCGGGTTTGGGCCGGGCAACTTCTCGGAGCTGTTC<br>418-R: CCCAAACCCGCCGCAGCCGC |
| H141R/N338D/ G342D/K418P | 418-CCG-F: GCGGCTGGGGGGGGTTTGGGCCGGGCAACTTCTCGGAGCTGTTC<br>418-R: CCCAAACCCGCCGCAGCCGC |
| H141R/N338D/ G342D/G419F | 419-TTC-F: GCTGCGGGGGTTTGGGAAGTTCAACTTCTCGGAGCTGTTCAAG<br>419-R: CTTCCCAAACCCGCCGCAGC |
| H141R/N338D/ G342D/P386T | 370-GAC-F: GGGTGCTCGTGGACAGGGATGACCAGGGGGTGTTGCTCCAGAT0<br>370-R: ATCCCTGTCCACGAGCACC0 |
| H141R/N338D/ G342D/R346C | 346-F-2: CTACGACGACGTGCGGCGGTGCGCCGGGGACGTGCTCTCG<br>346-R-2: CCGCCGCACGTCGT0GTAG |
| H141R/N338D/ G342D/R346H | 346-F-3: CTACGACGACGTGCGGCGGCACGCCGGGGACGTGCTCTCG<br>346-R-2: CCGCCGCACGTCGTCGTAG |
| H141R/G342D/ K418P/G419F | 418-CCG-419-TTC-F: CGGCTGCGGCGGGTTTGGGCCGTTCAACTTCTCGGAGCT GTTCAAG<br>418-R: CCCAAACCCGCCGCAGCCGC |
| H141R/G342D/ L276W/P277N | 276-TGG-277-AAT-F: GCGGAGACCGTGCTGCTGAATCTCAACGAGCCGGTGCACG<br>276-277-R: CCACAGCACGGTCTCCGCGTTGTTGGC |
| H141R/N338D/ G342D/K418P/ G419F | 418-CCG-419-TTC-F: CGGCTGCGGCGGGTTTGGGCCGTTCAACTTCTCGGAGCT GTTCAAG<br>418-R: CCCAAACCCGCCGCAGCCGC |
| H141R/N338D/ G342D/G419F/ N420S | 419-TTC-420-TCG-F: GCGGCGGGTTTGGGAAGTTCTCGTTCTCGGAGCTGTTCAA G<br>419-TTC-420-TCG-R: GAACTTCCCAAACCCGCCGC |
| H141R/N338D/ G342D/K418P/ G419F/N420S | 418-419-420-TCG-F: GCGGGGGGTTTGGGCCGTTCTCGTTCTCGGAGCT GTTCAAGTC<br>418-419-420-R: GAACGGCCCAAACCCGCCGC |
| H141R/N338D/ G342D/K418P/ G419F/N420T | 418-419-420-ACT-F: GCGGGGGGTTTGGGCCGTTCACTTTCTCGGAGCTGTTC AAGTC<br>418-419-420-R: GAACGGCCCAAACCOGCCGC |
| H141R/N338D/ G342D/R346C/ K418P/G419F/ N420S | 346-F-2: CTACGACGACGTGCGGCGGTGCGCCGGGGACGTGCTCTCG<br>346-R-2: CCGCCGCACGTCGTCGTAG |
| H141R/N338D/ G342D/R346H/ K418P/G419F/ N420S | 346-F-3: CTACGACGACGTGCGGCGGCACGCCGGGGACGTGCTCTCG<br>346-R-2: CCGCCGCACGTCGTCGTAG |
| P277N/P336D/ N338D/G342D | 277-AAT-F: GCGGAGACCGTGCTGCTGAATCTCAACGAGCCGGTGCACG<br>277-R: CAGCAGCACGGTCTCCGCGTTGTTG |
| P277N/N338D/ G342D/R346C | 277-AAT-F: GCGGAGACCGTGCTGCTGAATCTCAACGAGCCGGTGCACG<br>277-R: CAGCAGCACGGTCTCCGCGTTGTTG |
| P277N/N338D/ K418P/G419F | 277-AAT-F: GCGGAGACCGTGCTGCTGAATCTCAACGAGCCGGTGCACG<br>277-R: CAGCAGCACGGTCTCCGCGTTGTTG |
| H141R/P277N/ N338D/G342D/ K418P/G419F/ N420S | 277-AAT-F: GCGGAGACCGTGCTGCTGAATCTCAACGAGCCGGTGCACG<br>277-R: CAGCAGCACGGTCTCCGCGTTGTTG |
| H141R/P277N/ P336D/N338D/ G342D/K418P/ G419F/N420S | 1-336D-F1: TCGAGTTCTTGGCGCCGCCGGATCCCGACTACTACGACGACG<br>1-336D-R1: CGGCGGCGCCAAGAACTCG |
| H141R/G336D/ G342D/K418P/ G419F/N420S | 336-GAC-F: GAGTTCTTGGCGCCGCCGGATCCCAACTACTACGACGACG<br>336-R: CGGCGGCGCCAAGAACTCGAAGCCGC |

After detections, it had been found that the color reaction of the above combinations of two mutation sites was weak macroscopic observation, within 100 μM of the compound 101 for all of them; in the combinations of three, four or more sites, the color reaction of H141R/G342D/N338D/R346C, H141R/G342D/N338D/R346H, H141R/G342D/N338D/K418P, H141R/G342D/N338D/G419F and H141R/G342D/N338D/G419F/N420S was strong, and there was color even at the concentration of the compound 101 of 1000-2000 μM (as shown in FIG. 9).

To sum up, the single-site mutations exhibited resistance at 10-20 μM; the combinations of two mutation sites exhibited resistance at around 20-120 μm, and the resistance was stronger than that of the single-site mutations, and the color was lighter at 100 μM; the combinations of three mutation sites, i.e., H141R/N338D/G342D, H141R/G342D/K418P, H141R/G342D/G419F, 338D/342D/346C/H, H141R/G342D/N420S, H141R/N338D/N420S and the like, exhibited good resistance in order, and there was still light color at up to 1000 μM; the combinations of four or more mutation sites, i.e., H141R/N338D/G342D/K418P, H141R/G342D/K418P/G419F, H141R/N338D/G342D/R346C, H141R/N338D/G342D/R346H, H141R/N338D/G342D/K418P/G419F, H141R/N338D/G342D/G419F/N420S, H141R/N338D/G342D/K418P/G419F/N420S and the like, exhibited higher resistance, and the color was still significant at the concentration of the compound 101 up to 2500 μM.

Example 6 Expression, Isolation and Purification of OsHPPD Protein

The rice OsHPPD protein and homogentisate 1,2-dioxygenase (HGD) were obtained by heterologously expressed in *E. coli* wherein the gene was inserted into the pET 15b expression vector and expressed in the BL21 (DE3) expression strain, and purified by the Ni-NTA resin.

(1) The HPPD open reading frame (ORF) of the positive clone was cloned into the pET-15b vector to form a 6His-HPPD expression vector, and transformed into the BL21 (DE3) cell. The expression strain was inoculated in 10 mL of 2×YT culture medium, and cultivated overnight on a shaker at 37° C. and 200 rpm. The 10 mL of the culture was inoculated in 1 L of 2×YT culture medium and cultivated until the $OD_{600}$ reached 0.6-0.8, cooled to a temperature of 16° C., and subjected to induced-expression with 0.2 mM IPTG (isopropyl thiogalactoside) overnight. The strains were collected by centrifugation at 2800×g.

(2) The collected strains were re-suspended with the buffer A (50 mM Tris pH 8.0, 500 mM NaCl, 20 mM imidazole), to which PMSF (phenylmethanesulfonyl fluoride) at the final concentration of 1 mM and 250 μL of a protease inhibitor cocktail (i.e., a mixture of multiple protease inhibitors), and mixed. The cells were broken by ultrasound in ice-bath (40% total power, work for 3 seconds/6 seconds interval, 2×30 minutes (Ningbo Scientz Biotechnology Co., Ltd., Ningbo, China)), and centrifuged at 12000 rpm at 4° C. for 30 minutes; and the supernatant was filtered with a 0.22 μm filter membrane.

(3) Purification with the Ni-NTA column: the supernatant was in contact with the Ni-NTA resin, then rinsed with a buffer A containing 50 mM imidazole to remove the impurities, and finally, eluted with an elution buffer containing 400 mM imidazole.

(4) The approximate purity of the protein of interest was analyzed by SDS-PAGE. The eluates containing of the protein of interest were combined and concentrated by an ultrafiltration device (10 kDa molecular weight cut-off, Amicon Ultra). The solution was replaced with a solution containing 20 mM Tris-HCl and having a pH of 7.5 for at least 3 times to desalt. The total protein concentration was determined by the BCA method. All expressed and purified rice HPPD wild type and various mutants thereof were shown in Table 9.

TABLE 9

| Rice HPPD WT and various combinations of mutation sites | |
|---|---|
| No. | Mutant |
| 1 | WT |
| 2 | H141R/G342D/G419F |
| 3 | H141R/N338D/G342D |
| 4 | H141R/G342D/K418P |
| 5 | H141R/N338D/G342D/P386T |
| 6 | N338D/G342D/R346C |
| 7 | N338D/G342D/R346H |
| 8 | H141R/N338D/G342D/R346C |
| 9 | H141R/N338D/G342D/R346H |
| 10 | H141R/N338D/G342D/K418P |
| 11 | H141R/N338D/G342D/K418P/G419F/N420S |
| 12 | H141R/G342D/P277N |
| 13 | N338D/G342D |
| 14 | G342D/R346C |
| 15 | H141R/N338D/N420S |

(5) Dialysis or passing through desalination column: the buffer was replaced with a stock solution of 50 mM Tris pH 8.0 and 500 mM NaCl. The concentration was determined by the BCA method. After packaged and quickly frozen with liquid nitrogen, the eluate was stored in a −80° C. refrigerator.

Example 7 Determination of the Effect of Compounds on Various Enzymatic Parameters of OsHPPD Proteins 1. The activity of a HPPD enzyme was determined by detecting the conversion of 4-hydroxyphenylpyruvate (4-HPP) to homogentisic acid (HGA) catalyzed by the HPPD enzyme and the conversion of HGA to maleylacetoacetate (MAA) catalyzed by homogentisate dioxygenase. The maleylacetoacetate had a maximum absorption at 318 nm and an absorption constant of 14.7 OD $M^{-1} \cdot cm^{-1}$.

2. 6 μl of 4-hydroxyphenylpyruvate (4-HPP) having a concentration that was as 50 times as the final concentration of the substrate were added to to an ELSA plate, and then 294 μL of hydroxyethylpiperazine ethanesulfonic acid (HEPES) with a final concentration of 25 mM and pH of 7, 2 mM of Vitamin C, 10 mM $FeSO_4$, 50 nM homogentisate dioxygenase and 5 to 240 nM HPPD enzyme were added thereto at one time. The final concentration of reaction substrate 4-HPP usually ranged from 1 to 100 μM.

3. The absorbance changes of the reaction wells at 318 nm were continuously monitored by a UV ELISA detector (ReadMax 1900 photoabsorption type full-wavelength microplate reader) (Shanghai).

4. Determination of $K_m$, $K_{cat}$ and $K_{cat}/K_m$ of OsHPPDs $V_{max}$ is the maximum catalytic reaction rate achievable by enzymatic catalysis. The Michaelis constant $K_m$ is the concentration of a substrate required when the enzyme catalyzed the reaction to achieve half of the maximum rate ($V_{max}$). The $K_m$ value is a constant and independent of the enzyme concentration, and altered as substrate type, reaction temperature, pH, and ionic strength changed. Kit is a catalytic constant of an enzyme and referred to the number of substrate molecules that could be catalyzed by an enzyme molecule or enzyme active center per second. $K_{Cat}/K_m$ represents the catalytic efficiency of enzyme. The enzymatic parameters of wild-type rice HPPD (WT) and various mutants were determined, as shown in Table 10. It could be seen from the data in the table that the catalytic efficiency of most HPPD mutants was enhanced.

TABLE 10

Determination of maximum reaction rate $V_{max}$ and Michaelis constant $K_m$.

| OsHPPD | $K_{cat}$ | $K_m$ | $K_{cat}/K_m$ |
|---|---|---|---|
| WT | 914 | 6.7 | 136 |
| H141R/G342D/D370N | 1596 | 10.9 | 146 |
| H141R/G342D/G419F | 3211 | 7.9 | 406 |
| H141R/N338D/G342D | 2730 | 6.3 | 433 |
| H141R/G342D/K418P | 2999 | 30.6 | 98 |
| H141R/N338D/G342D/P386T | 3018 | 9.7 | 311 |
| N338D/G342D/R346C | 980 | 9.5 | 103 |

TABLE 10-continued

Determination of maximum reaction rate $V_{max}$ and Michaelis constant $K_m$.

| OsHPPD | $K_{cat}$ | $K_m$ | $K_{cat}/K_m$ |
|---|---|---|---|
| N338D/G342D/R346H | 941 | 6.3 | 149 |
| H141R/N338D/G342D/R346C | 1739 | 7.4 | 235 |
| H141R/N338D/G342D/R346H | 2151 | 7.6 | 283 |
| H141R/N338D/G342D/K418P | 2001 | 18.8 | 106 |
| H141R/N338D/G342D/K418P/G419F/N420S | 935 | 23 | 41 |
| H141R/G342D/P277N | 186 | 1.1 | 169 |
| N338D/G342D | 206 | 2.1 | 98 |
| G342D/R346C | 220 | 5.9 | 37 |
| H141R/N338D/N420S | 823 | 5.1 | 161 |

5. Determination of inhibitory activity ($IC_{50}$) of the herbicide 101 and huanbifucaotong against OsHPPD proteins Inhibitory activity of the metabolic product of shuangcaozuotong and huanbifucaotong against rice wild-type (WT) and various mutant OsHPPD proteins was determined, as shown in FIG. 10 and Table 11, from which it could be seen that the $IC_{50}$ values of the compound 101 and huanbifucaotong herbicide compound for various mutants were obviously enhanced compared to that for the wild-type. For example, the $IC_{50}$ value of the compound 101 herbicide compound for the H141R/N338D/G342D/K418P/G419F/N420S mutant was increased by 13.7 times relative to that for the wild-type, while the $IC_{50}$ value of huanbifucaotong for the mutant was increased to 1.8 times. The increase of $IC_{50}$ value indicated that the tolerance of these mutants to HPPD herbicides was improved. Due to the unique properties of each of 101 and huangbifucaotong, the degree of the increased $IC_{50}$ value is not completely consistent for the two HPPD herbicides.

TABLE 11

IC50 values of HPPD inhibitora 101 and huanbifucaotong for WT and various mutant OsHPPDs

| OsHPPDs | $IC_{50}$ | | | |
|---|---|---|---|---|
| | 101 (μM) | Multiple | Huanbifucaotong | Multiple |
| WT | 7.6 | 1.0 | 1.1 | 1.0 |
| H141R/G342D/D370N | 41 | 5.4 | 8.7 | 7.9 |
| H141R/G342D/G419F | 43 | 5.7 | 4.1 | 3.7 |
| H141R/N338D/G342D | 24 | 3.2 | 4.9 | 4.5 |
| H141R/G342D/K418P | 72 | 9.5 | 13 | 11.8 |
| H141R/N338D/G342D/P386T | 51 | 6.7 | 14 | 12.7 |
| N338D/G342D/R346C | 50 | 6.6 | 5.9 | 5.4 |
| N338D/G342D/R346H | 85 | 11.2 | 8.7 | 7.9 |
| H141R/N338D/G342D/R346C | 57 | 7.5 | 4.8 | 4.4 |

TABLE 11-continued

IC50 values of HPPD inhibitora 101 and huanbifucaotong for WT and various mutant OsHPPDs

| OsHPPDs | 101 (μM) | Multiple | Huanbifucaotong | Multiple |
|---|---|---|---|---|
| H141R/N338D/G342D/R346H | 72 | 9.5 | 6.8 | 6.2 |
| H141R/N338D/G342D/K418P | 93 | 12.2 | 6.0 | 5.5 |
| H141R/N338D/G342D/K418P/G419F/N420S | 104 | 13.7 | 2.0 | 1.8 |
| H141R/G342D/P277N | 93 | 12.2 | 27.0 | 24.5 |
| N338D/G342D | 122 | 16.1 | 15.0 | 13.6 |
| G342D/R346C | 44 | 5.8 | 3.1 | 2.8 |
| H141R/N338D/N420S | 18 | 2.4 | 1.0 | 0.9 |

6. Determination of enzyme fitness of OsHPPD proteins to inhibitors

Enzyme fitness is an indicator of the adaptability of an enzyme to an inhibitor, and the higher the value is, the stronger the resistance of the enzyme to the inhibitor is. Since the concentration of a substrate during the reaction is much larger than the $K_m$ value and the reaction conditions of the different OsHPPD mutants are the same, the $K_{cat}$ could be replaced by the $V_{max}$ achieved by catalysis at the same concentration of enzyme (500 nM). Enzyme fitness=$K_{cat}*K_m^{-1}*Ki$, $Ki=IC_{50}/(1+S/K_m)$ (inhibition constant). The inhibition constants of herbicide compounds 101 and huanbifucaotong against rice HPPD WT and various mutants and corresponding enzyme fitness thereto were detected to further evaluate the tolerance of these mutants to the herbicides. The mentioned results in Table 12 indicate that the enzyme fitness of the mutants all have different levels of enhancement relative to WT, confirming their enhanced tolerance.

TABLE 12

Determination of enzyme fitness of OsHPPDs to different compounds.

| | | | | Ki | | Enzyme Fitness | |
|---|---|---|---|---|---|---|---|
| OsHPPD | $K_{cat}$ | $K_m$ | $K_{cat}/K_m$ | 101 | Huanbifucaotong | 101 | Huanbi Fucaotong |
| WT | 914 | 6.7 | 136 | 0.25 | 0.036 | 34 | 4.9 |
| H141R/G342D/D370N | 1596 | 10.9 | 146 | 2.12 | 0.450 | 310 | 66 |
| H141R/G342D/G419F | 3211 | 7.9 | 406 | 1.63 | 0.156 | 664 | 63 |
| H141R/N338D/G342D | 2730 | 6.3 | 433 | 0.73 | 0.150 | 318 | 65 |
| H141R/G342D/K418P | 2999 | 30.6 | 98 | 9.55 | 1.725 | 936 | 169 |
| H141R/N338D/G342D/P386T | 3018 | 9.7 | 311 | 2.36 | 0.648 | 734 | 20 |
| N338D/G342D/R346C | 980 | 9.5 | 103 | 2.27 | 0.268 | 234 | 28 |
| N338D/G342D/R346H | 941 | 6.3 | 149 | 2.60 | 0.266 | 388 | 40 |
| H141R/N338D/G342D/R346C | 1739 | 7.4 | 235 | 2.03 | 0.171 | 478 | 40 |
| H141R/N338D/G342D/R346H | 2151 | 7.6 | 283 | 2.64 | 0.249 | 746 | 70 |
| H141R/N338D/G342D/K418P | 2001 | 18.8 | 106 | 7.99 | 0.516 | 851 | 55 |
| H141R/N338D/G342D/K418P/G419F/N420S | 935 | 23 | 41 | 10.73 | 0.206 | 436 | 8.4 |
| H141R/G342D/P277N | 186 | 1.1 | 169 | 0.25 | 0.036 | 86.0 | 25.0 |
| N338D/G342D | 206 | 2.1 | 98 | 0.51 | 0.148 | 124.4 | 15.3 |
| G342D/R346C | 220 | 5.9 | 37 | 1.27 | 0.156 | 47.0 | 3.3 |
| H141R/N338D/N420S | 823 | 5.1 | 161 | 1.26 | 0.089 | 72.2 | 4.0 |

In summary, a series of enzymatic tests confirmed that the tolerance of rice OsHPPD mutants to the herbicides was improved compared with wild type WT. Among them, the quadruple-site mutant H141R/N338D/G342D/K418P, which showed the strongest resistance in the color reaction, also exhibited higher resistance in in vitro enzyme activity experiments. Moreover, the results showed that the mutants having the K418P mutation exhibited greatly improved resistance but reduced affinity to substrate ($K_m$). The mutant H141R/G342D/P277N and the mutant H141R/N338D/G342D/K418P had comparable resistance and the affinity thereof to substrate ($K_m$) was not reduced. In addition, the triple-site mutant H141R/N338D/G342D and quadruple-site mutant H141R/N338D/G342D/P386T also had relatively high resistance, and the $K_m$ thereof was not reduced. The shortest triple mutant N338D/G342D/R346H also exhibited good resistance and was easy to be edited.

N338D/G342D/R346H (the shortest, suitable for homologous replacement HDR), H141R/N338D/G342D (shorter, also suitable for homologous replacement) and H141R/N338D/N420S (suitable for base editing, stronger resistance) were preferentially considered for further tests. After subjected to transgenosis and gene editing, plants were detected for tolerance changes thereof.

Example 8 Overexpression of the Triple-Site Mutant OsHPPD3M in Transgenic Rice

1. Construction of overexpression vector
1) Primers: primers were designed according to the selected restriction sites and the nucleotide sequence of the gene itself to amplify the three-site mutant HPPD (H141R/G342D/D370N) (OsHPPD3M). The designed primers were synthesized by Beijing Qingke Biotechnology Co., Ltd.: HPPD-F, GATAGCCGGTACGGGTTCGAGCCACC ATGCCTCCCACT CCCACCC, HPPD-R, CATCTTTGTAATCGGGGTACCTAGGATCCTT-GAACTGTAGG GGC.
2) PCR amplification: the gene of interest was amplified by using the synthesized primer and Q5 DNA polymerase (NEB, New England Biolabs, Boston, USA). The amplified product was assayed by agarose gel electrophoresis, and the product was recovered according to operational instructions of the TIANquick Midi Purification kit. After the completion of the recovery, the concentration of extracted DNA was determined by Nanodrop.
3) Construction of a rice overexpression vector: the rice overexpression vector pCAMBIA1301-OsHPPD3M was constructed with the recovered HPPD fragments and plasmid pCAMBIA1301 digested by KpnI and HindIII by using the HB-in Fusions™ seamless cloning kit of HanBio Biotechnology Co., Ltd., (Shanghai), and then transformed into the competent E. coli DH5α to obtain a positive clone; the positive clone was transformed into Agrobacterium after sequencing and restriction endonuclease digestion.
2. Rice calli infected with transformed Agrobacterium and occurrence of transgenic event
1) The rice overexpression vector pCAMBIA1301-OsHPPD3M and the empty vector pCAMBIA1301 which only expressed mCherry (a marker gene of fluorescent protein) were added in 1 µg for each to the competent Agrobacterium EH105, respectively, placed on ice for 5 minutes, rapidly frozen by immersing in liquid nitrogen for 5 minutes, stood at 37° C. for 5 minutes and finally placed on ice for 5 minutes; to which 500 µl of YEB solution culture (antibiotic-free) was added, and cultivated on a shaker at 28° C. and 200 rpm for 2-3 hours; the cells were collected by centrifugation at 3500 rpm, and the collected cells were applied on the YEB (kalamycin+rifampicin) plate and cultivated for 2 days in a 28° C. incubator; the single clones were picked out, cultivated in a liquid medium and stored at −80° C.
2) Cultivation of agrobacterium: the transformed monoclonal Agrobacterium was picked out and cultured in the YEB liquid medium (caramycin+rifampicin) at 28° C. until the $OD_{600}$ was of 0.5, the colonies were collected at 3500 rpm, diluted with equal amount of AAM (1 ml AAM+1 µl 1000×AS) liquid medium, and used to infect a callus.
3) Induction of callus of rice variety Zhonghua 11: prior to the preparation of Agrobacterium, rice callus was prepared at first. Rice seeds were peeled, washed with sterile water until the washing water became clear without limiting washing times, disinfected with 70% alcohol for 30 seconds and then with 5% sodium hypochlorite, then cultivated in a horizontal shaker for 20 minutes, disinfected with sodium hypochlorite and washed with sterile water for 5 times, placed on a sterile absorbent paper to air-dry the water of surface of the seeds, and inoculated in an induction medium to cultivate the callus at 28° C.
4) Infection of rice callus with the agrobacterium: the calli of Huaidao No. 5 with a diameter of 3 mm were selected and sub-cultured for 10 days, and the calli were collected into a 50 ml centrifuge tube. A bacterial solution of Agrobacterium with a modulated concentration was added to the centrifuge tube containing the calli, and the centrifuge tube was placed on a shaker at 28° C. and 200 rpm to infect for 20 minutes; after the infection was completed, the bacterial solution was discharged, and the calli were placed on a sterile filter paper and air-dried for about 20 minutes and co-cultivated on a co-culture plate on which an sterile filter paper wetted with an AAM (1 ml AAM+30 µl 1000× AS) liquid culture was covered; after 3 days of infestation, Agrobacterium was washed and removed (i.e., washed with sterile water for 5 times and then washed with 500 mg/L of cephalosporin antibiotic for 20 minutes), and the calli were cultivated in 50 mg/L of a hygromycin screening medium.
5) Screening, differentiation and rooting of resistant calli: the co-cultured calli were transferred to a screening medium for the first round of screening (2 weeks); after the first round of screening, the newly grown calli were transferred to a screening medium (containing 50 mg/L hygromycin) for the second round of screening (2 weeks); after the screening was completed, blond calli with a good growth state were picked out for differentiation, and 1 µM-5 µM of tembotrione was added to a differentiation medium for the screening of herbicide resistance. After 3 to 4 weeks, seedlings of about 1 cm were obtained. The differentiated seedlings were transferred to a rooting medium for rooting culture; the rooted seedlings were subjected to an acclimatization treatment, and then transferred to a pot containing soil for cultivation in a greenhouse; and 55 OsHPPD3M seedlings or events were obtained.
3. Preliminary detection of herbicide resistance of transgenic seedlings (TO generation): 1-5 µM of tembotrione was added a differentiation medium, and the results showed that seedlings with empty vector control were not tolerant to tembotrione, while transformed seedlings overexpressing the triple-site mutant HPPD (H141R/G342D/D370N) were tolerant to 3 μM of tembotrione, as shown in FIG. 11.

4. Re-detection of herbicide resistance of transgenic seedlings (TO generation): The TO generation transgenic seedlings were transplanted into large plastic buckets in the greenhouse to obtain T1 generation seeds. Two events were randomly selected from overexpressed mutant events at jointing stage, and herbicide resistance of the two events and a non-transgenic rice variety Zhonghua 11 at the same growth stage as control were detected. The herbicide used was shuangzuocaotong. The field rate of shuangzuocaotong was usually 4g a.i./mu. In this test, the rate of shuangzuocaotong was of 8 and 16 g per mu.

Results of resistance detection: on the $5^{th}$ day after the spraying (16 g/mu) and the $7^{th}$ day after the spraying (8 g/mu), the non-transgenic rice seedlings began to become bleached, but the overexpressed transgenic mutants, Event 1, Event 2, Event 3 and Event 4, were green. After 32 days of the spraying, the non-transgenic seedlings sprayed with the herbicide were almost nearly dead, but the overexpressed transgenic mutants, which were treated with the herbicide in 8 g/mu or 16 g/mu, were still green, grew normally, and began to earing (as shown in FIGS. 12A and 12B).

5. Re-detection of herbicide resistance of transgenic seedlings (T1 generation):
  a) Three events selected from the overexpressed transgenic mutant HPPDs, Event 20, Event 28 and Event 37 and non-transgenic wild type Huaidao No. 5 (Huaidao No. 5 had a higher natural tolerance to HPPD inhibitor Shuangzuocaotong than Zhonghua 11, and the resistance multiple could not be calculated on the base of Huaidao No. 5, and the actual resistance should be higher) were used.
  b) The rates of shuangzuocaotong used were 0, 4, 8, 16, 32 and 64g/mu. Due to the low temperature and weak illumination in the greenhouse in winter, the symptoms of phytotoxicity appeared slowly. Aon the 14th day of the spraying, the non-transgenic Huaidao No. 5 treated with 32 and 64 g/mu of the herbicide showed symptoms, but the transgenic events were asymptomatic and remained green (FIGS. 12C and 12D).

In conclusion, overexpressed triple-site mutant OsHPPD3M (H141R/G342D/D370N) could enhance the resistance of transgenic rice varieties to the HPPD-inhibiting herbicide by a resistance multiple of at least 4. From the preliminary observation of the growth, development, flowering and fruiting of TO generation and T1 generation, it could be seen that most of the plants were normal.

Example 9 Determination of HPPD Copy Number Overexpressed in Transgenic Rice

Hygromycin resistant gene: the rice hppd (Oshppd) gene had a high GC content, which affected the efficiency of PCR amplification. In addition, there is an endogenous copy of hppd in rice. Therefore, the selective marker gene hygromycin resistant gene hyg was chosen as an exogenous gene and sucrose phosphate synthase (SPS) gene was chosen as an endogenous reference gene to estimate copy number. SPS gene was a rice-specific gene and was a single copy that could serve as an endogenous reference gene for rice (Ding Jiayu, Jia Junwei, Yang Li tao et al. Validation of a rice specific gene, sucrose phosphate synthase, used as the endogenous reference gene for qualitative and real-time quantitative PCR detection of transgenes [J]. J. Agric. Food Chem., 2004, 52: 3372-7). The copy number of overexpressed hppd could be estimated indirectly by determining the copy number of the selective marker gene hygromycin resistant gene (hyg) of transgenic rice.

Genome DNA: the genomic DNA of rice leaf was extracted and purified by using a plant genomic DNA extraction kit of Tian'gen Biotech (Beijing) Co., Ltd., and the content and purity of DNA were detected by a Nanodrop nucleic acid analyzer (Nanodrop). When the ratio of OD260/OD280 was in the range of 1.8-2.0 and the purity was believed to be good when the ratio of OD260/OD230 was about 2.0.

Primers: two pairs of primer were designed: Hyg-F: 5'-GTACACAAATCGCCCGCAG-3' and Hyg-R: 5'-TCTATTTCTTTGCCCTCGGAC-3' were used to amplify an 111 bp fragment of the hygromycin resistant gene in length; Sps-F: 5'-GTACACAAATCGCCCGCAG-3' and Sps-R: 5'-TCTATTTCTTTGCCCTCGGAC-3' were used to amplify a 170 bp fragment of sucrose phosphate synthase (SPS) gene.

Quantitative PCR reaction system: the reaction solution (20 μL) was prepared in accordance with the SYBR Premix ExTaq II system for real-time fluorescent quantitative PCR. PCR amplification procedure: pre-denaturation at 95° C./30S, then 95° C./5S→55° C./30S→72° C./30S, 40 cycles.

Drawing of standard curve: a 400 bp sequence of the SPS or of HYG gene which contained the quantitatively PCR-amplified fragment was selected, respectively, and they were ligated together by homologous recombination and then ligated into the pClone007 vector. The constructed standard product plasmid containing the HYG gene and SPS gene was digested with the restriction endonuclease PshaI into linearized DNAs, measured with a nucleic acid protein detector for concentration thereof, and diluted with gradient $ddH_2O$ to $10^6$ copies/μL, $10^5$ copies/μL, $10^4$ copies/μL, $10^3$ copies/μL and $10^2$ copies/μL. The five standard samples with different dilutions and a control were simultaneously amplified, and three technical replicates were set for each sample. PCR amplification was carried out as described above. Conversion formula between concentration and copy number was: copy number (copy/mL)=($6.02 \times 10^{23}$ copies/mol)×(DNA concentration g/ml)/(MW g/mol). Average molecular weight (MW g/mol): dsDNA=(number of bases)×(660 dalton/bp).

Calculation of transgene copy number: each sample tested had a cycle number Ct when it reached the threshold value. The Ct value was substituted into the standard curve to obtain the amount of initial template in the sample, the ratio of the amount of initial templates of gene of interest to the amount of initial templates of the endogenous gene of the initial template number was the copy number of the gene of interest. The data obtained from the experiments were exported by software and analyzed by Excel.

Real time fluorescence quantification PCR: the expression levels of relevant genes in transgenic rice were analyzed by using qRT-PCR method to validate the efficiency of gene overexpression. The UBQ5 gene of rice was used as an endogenous reference gene. A reaction solution was prepared for real time fluorescence quantification PCR. The reaction liquid (20 μL) was prepared according to SYBR Premix ExTaq II system. The qRT-PCR amplification procedure was below: pre-denaturation at 95° C. for 30 s; denaturation at 95° C. for 5 s; annealing at 60° C. for 30 s; extension at 65° C. for min, with a total of 40 cycles. The data obtained from the experiment were exported by software and analyzed by Excel. The relative expression levels of genes were calculated by FACT. Three independent biological replicates were set for all samples.

In this test, 54 positive-PCR plants and 4 non-transgenic plants as controls were selected, and a genomic DNA was extracted by a plant genomic DNA extraction kit. Each sample had three replicates for quantitative PCR reaction to obtain amplification curve, wherein the fluorescence threshold was set in the same manner for drawing the gene standard curve. The Ct value of a sample to be tested was obtained, and the number of initial templates of the HYG gene of the sample was calculated by the equation: $HYG_0=10^{(-0.260CT+10.442)}$, and the number of initial templates of the Sps gene of this sample was calculated by the equation: $SPS_0=10^{(-0.260CT+10.172)}$. Since the rice endogenous reference gene Sps was a homozygous diploid, and the probability that the exogenous gene of a transgenic plant was a homozygote was very small, the copy number of the gene of interest in the rice genome was equal to a value obtained by multiplying the data obtained by dividing the number of initial templates of HYG by the number of initial templates of SPS by 2. The number of initial templates of the gene of interest Hyg was compared the number of initial templates of rice endogenous reference gene Sps, and the results in Table 13 showed that, among the 54 transgenic plants, 36 plants had a copy number of 1, 13 plants had a copy number of 2, 4 plants had a copy number of 3, and 1 plant had a copy number of 4, while the copy number of negative control was 0.

TABLE 13

Estimation of copy number of gene of interest in transgenic plants

| Line | $SPS_0$ | $HYG_0$ | $2 \times HYG_0/SPS_0$ | Gene of interest copy number |
|---|---|---|---|---|
| Zhonghua 11 | 314808.9 | 13585.07 | 0.086 | 0 |
| WT-4 | 794343.5 | 5099.921 | 0.013 | 0 |
| WT-7 | 82126.33 | 4772.3 | 0.116 | 0 |
| WT-8 | 107315 | 3540.487 | 0.066 | 0 |
| 2-1 | 86158.95 | 70975.65 | 1.648 | 2 |
| 2-2 | 116048.5 | 97043.28 | 1.672 | 2 |
| 2-3 | 98298.14 | 52089.59 | 1.060 | 1 |
| 2-4 | 95761.67 | 48540.84 | 1.014 | 1 |
| 2-5 | 99197.34 | 49539.5 | 0.999 | 1 |
| 2-6 | 114053.7 | 180145.4 | 3.159 | 3 |
| 2-8 | 126539 | 105285.7 | 1.664 | 2 |
| 2-9 | 98094.43 | 98837.9 | 2.015 | 2 |
| 2-10 | 87087.68 | 116834.4 | 2.683 | 3 |
| 2-11 | 92351.87 | 144727.1 | 3.134 | 3 |
| 2-12 | 78140.72 | 83886.76 | 2.147 | 2 |
| 2-13 | 158780.3 | 113069.3 | 1.424 | 1 |

TABLE 13-continued

Estimation of copy number of gene of interest in transgenic plants

| Line | $SPS_0$ | $HYG_0$ | $2 \times HYG_0/SPS_0$ | Gene of interest copy number |
|---|---|---|---|---|
| 2-14 | 192380.3 | 58948.64 | 0.613 | 1 |
| 2-15 | 238932 | 74397.84 | 0.623 | 1 |
| 2-16 | 161045.9 | 85497.1 | 1.062 | 1 |
| 2-17 | 35298.61 | 17620.82 | 0.998 | 1 |
| 2-18 | 213886.9 | 61843.61 | 0.578 | 1 |
| 2-19 | 176775.1 | 57200.14 | 0.647 | 1 |
| 2-20 | 621936.9 | 368999.1 | 1.187 | 1 |
| 2-21 | 594530.9 | 305098.9 | 1.026 | 1 |
| 2-22 | 224816.7 | 117195.8 | 1.043 | 1 |
| 2-23 | 77450.64 | 40664.82 | 1.050 | 1 |
| 2-24 | 269156.5 | 150371.3 | 1.117 | 1 |
| 2-25 | 208228.7 | 75186.45 | 0.722 | 1 |
| 2-26 | 169627 | 60077.38 | 0.708 | 1 |
| 2-27 | 56297.91 | 34315.9 | 1.219 | 1 |
| 2-28 | 653765.2 | 400797.1 | 1.226 | 1 |
| 2-29 | 80636.42 | 39719.64 | 0.985 | 1 |
| 2-30 | 82451.61 | 36849.85 | 0.894 | 1 |
| 2-31 | 201228.8 | 71250.85 | 0.708 | 1 |
| 2-32 | 101126.2 | 45752.07 | 0.905 | 1 |
| 2-33 | 278596 | 162471.6 | 1.166 | 1 |
| 2-34 | 114698 | 91280.03 | 1.592 | 2 |
| 2-35 | 116576.8 | 52873.89 | 0.907 | 1 |
| 2-36 | 82680.12 | 37455.65 | 0.906 | 1 |
| 2-37 | 568452.8 | 344492.4 | 1.212 | 1 |
| 2-38 | 69154.81 | 85884.22 | 2.484 | 2 |
| 2-39 | 105306.9 | 87417.86 | 1.660 | 2 |
| 2-40 | 239703.1 | 371019.4 | 3.096 | 3 |
| 2-41 | 278420.5 | 545540.6 | 3.919 | 4 |
| 2-42 | 238414.5 | 124542.9 | 1.045 | 1 |
| 2-43 | 228641.5 | 127467.9 | 1.115 | 1 |
| 2-44 | 231265.5 | 119998.8 | 1.038 | 1 |
| 2-45 | 274609.7 | 136861.8 | 0.997 | 1 |
| 2-46 | 188432.1 | 99115.91 | 1.052 | 1 |
| 2-47 | 240136.8 | 197426.1 | 1.644 | 2 |
| 2-48 | 221332.8 | 230365.3 | 2.082 | 2 |
| 2-49 | 236717.4 | 131366 | 1.110 | 1 |

TABLE 13-continued

Estimation of copy number of gene of interest in transgenic plants

| Line | SPS$_0$ | HYG$_0$ | 2×HYG$_0$/SPS$_0$ | Gene of interest copy number |
|---|---|---|---|---|
| 2-50 | 167319.1 | 77703.63 | 0.929 | 1 |
| 2-51 | 170851.6 | 197936.8 | 2.317 | 2 |
| 2-52 | 149266.1 | 132152.6 | 1.771 | 2 |
| 2-53 | 139016 | 135037 | 1.943 | 2 |
| 2-54 | 183699.9 | 77684.4 | 0.846 | 1 |
| 2-55 | 182604.6 | 98325.76 | 1.077 | 1 |

Note: HYG$_0$ and SPS$_0$ represented the number of initial templates of Hyg and of Sps gene in PCR reaction, respectively.

Example 10 Rice Varieties Tolerant to HPPD-Inhibiting Herbicides Obtained by Gene Editing Rice HPPD gene was mutated and screened, three mutation sites 141, 342 and 370 and combinations thereof were obtained, and tolerance in vitro to HPPD-inhibiting herbicides was tested. Based on this, a combined mutant OsHPPD3M (H141R/G342D1D370N) was overexpressed in a transgenic rice to confirm that the mutant was highly tolerant to HPPD-inhibiting herbicides. Then, the HPPD gene was gene-edited to obtain non-transgenic rice varieties tolerant to HPPD-inhibiting herbicides obtained by gene editing. First of all, the three sites corresponding to the amino acid position 141, 342 or 370 were subjected to base editing, respectively, and the three sites corresponding to the amino acid positions 141, 342 and 370 were subjected to homologous replacement. The gene editing process and results were as follows.

(1) Base editing is a gene editing method that utilized the CRISPR/Cas9 system to target deaminase to a specific site in the genome to modify the specific base. This method had been successfully applied in rice. For example: Yan F., Kuang Y., Ren B., Wang J., Zhang D., Lin H., Yang B., Zhou X., and Zhou H. (2018). High-efficient A-T to G-C base editing by Cas9n-guided tRNA adenosine deaminase in rice. Mol. Plant. doi: 10.1016 j.molp.2018.02.008.

In this example, the site of the rice HPPD gene located in the Os02g0168100 locus of the second chromosome a corresponding to the amino acid position 141, 342 or 370 was edited, respectively. The amino acid residue histidine (codon CAC) at the 141-position of in rice HPPD was edited into arginine (codon CGC; the original A was changed to G) by base editing. Similarly, the amino acid residue glycine (codon GGC) at position 342 was edited to aspartic acid (codon GAC; the original G was changed to A); the amino acid residue aspartic acid (Codon GAC) at the position-370 was edited to asparagine (codon AAC; the original G was changed to A). A mutant protein xCas9(3.7)-ABE of Cas9 protein with a broader PAM compatibility was selected as an editing tool (Hu, J. H. et al. Evolved Cas9 variants with broad PAM compatibility and high DNA specificity. Nature http://dx.doi.org/10.1038/nature26155 (2018)).

A sgRNA target site was designed according to the DNA sequence of rice HPPD gene near site correspond to the amino acid position 141: GGTGCaCGCCGTGGCGCTGC-GCG, wherein a represented the action site of ABE so as to realize the edition of G from A. The PAM of this sgRNA was GCG that meted with the requirements of xCas9 (3.7).

Similarly, a sgRNA target site was designed according to the DNA sequence of rice HPPD gene near site correspond to the amino acid position 342: GCACGcCGTCGTAGTAGTTG GGC, wherein c represented the action site of CBE so as to realize the edition of T from C. The PAM of this sgRNA was GGC that meted with the requirements of xCas9 (3.7).

The DNA sequence of rice HPPD gene near site correspond to the amino acid position 370 was analyzed to design a sgRNA target site: CCTGGTcATCCCTGTCCACG AGC, wherein c represents the action site of CBE, so as to realize the edition of T from C. The PAM of this sgRNA was GGC that meted with the requirements of xCas9 (3.7).

Accordingly, three pairs of primers: 141 GE-F: ggcgGTGCaCGCCGTGGCGCTGC and 141 GE-R: aaacGCAGCGCCACGGCGtGCAC; 342GE-F: ggcgCACGcCGTCGTAGTAGTTG and 342GE-R: aaac-CAACTACTACGACGgCGTG; 370GE-F: ggcgCCTGGT-cATCCCTGTCCACG and 370GE-R: aaacCGTGGACAGGGATgACCAGG, were synthesized, then diluted to 10 μM with ultrapure water, and mixed in equal amounts; the mixture was placed in a boiling-water bath, and cooled naturally to room temperature for ready. 1 μg of pQY000140 vector was cleaved by BsaI enzyme at 37° C. for one hour; after detection by agarose gel electrophoresis, the target fragment was recovered, then determined by ultraviolet absorption for concentration, mixed with an annealed fragment at a ratio of 1:10 and ligated with T4 DNA ligase (NEB, New England Biolabs, Boston, USA) at 16° C. for 2 hours, and transformed into the Trans5a competent cells (TransGen Biotech., Beijing). The transformed cells were cultivated at 37° C. overnight. Monoclonal component was sequenced by Sanger sequencing method to confirm whether the sequence of single-base edited vector was correct. The constructed vector pQY000141 was shown in FIG. 13. The correctly sequenced E. coli was cloned, and the plasmid was extracted and transformed into EH105 Agrobacterium (Shanghai Weidi Biotechnology Co., Ltd.).

The calli of Huaidao No. 5 (at least 3000 callis) were infected according to the aforesaid method for infecting rice callis with Agrobacterium. After being infected with Agrobacterium, the infected calli were transferred to a 50 mg/L hyg screening medium for screening culture. After three rounds (15 days×3) of screening, the blond calli with good growth state were picked out to differentiate in a differentiation medium, and 0.2 μM tembotrione was added during the differentiation process for screening. After for 3-4 weeks, about 1,500 seedlings with around 1 cm were obtained. As to the about 1,500 differentiated seedlings, the vast majority of which had been bleached, and only 4 seedlings remained normal green. The 4 seedlings were transplanted to a rooting medium containing 0.4 μM tembotrione and cultivated for 2 weeks, wherein two seedlings had been bleached, while the other two seedlings remained green (FIG. 14A). A small number of leaves were used to extract genomic DNA by CTAB method. PCR was carried out by using the primers oshppd54F: TTCCAC-CACGTCGAGCTC and Oshppd356R: GGTGAACCCG- GAGATGTACG. The amplified product was detected by 1% agarose electrophoresis and sequenced by Sanger sequencing method.

The sequencing results showed that: both of the two green seedlings (QY000141-1 and QY000141-2) were successfully edited (FIG. 14B) at the amino acid position 141, while the bleached ones were wild-type.

(2) Homologous replacement of rice HPPD mutant mediated by CRISPR/cas9 to obtain herbicide resistance After the triple-site mutant H141R/G342D/D370N overexpressed in transgenic event was obtained, the combination of the three mutation sites were subjected to homologous replacement in order to obtain non-transgenic rice with herbicide resistance.

The rice hppd gene has two exons and one intron. The three target sites H141, G342 and O370 are located at the first exon.

Design of gRNA: at least one gRNA was designed upstream of H141 and downstream of O370, respectively, and cleaved for once; and the three sites were simultaneously replaced by means of homologous replacement. The sequence of the exon 1 was input in http://crispor.tefor.net/to evaluate all possible gRNAs. According to the principles that specific scoring value is greater than 90 (Hsu P D, Scott D A, Weinstein J A, Ran F A, Konermann S, Agarwala V, Li Y, Fine E J, Wu X, Shalem O, Cradick T J, Marraffini L A, Bao G, Zhang F. Nat Biotechnol. 2013 September; 31(9): 827-32. doi: 10.1038/nbt.2647. Epub 2013 Jul. 21), off-target effect is avoided and the length is shorten as far as possible, the following two gRNAs were selected: OshppdgRNA-PAM1-2: 5'-GGAACGCGAGCGCCTG-GAAC CGG-3' (GC=70%) (bottom strand); and OshppdgRNA-PAM2-1 (GC=39%): 5'-CACCTCTTTCAT-GATGAAAA TGG-3'(top strand), wherein the underlined was the PAM sequence and the bolded G meant that that when a template DNA to be replaced is designed, this G will be changed to other bases on the replacement template to destroy the PAMs and avoid re-cutting after replacement.

The distribution of the two gRNA1-2 and gRNA2-1 in the rice genomic DNA was as shown in FIG. 15.

The design of template donor DNA was as shown in FIG. 16: according to tests conducted by Zhaoyunde Lab (Sun Y, Zhang X, Wu C, He Y, Ma Y, Hou H, Guo X, Du W, Zhao Y, Xia L. Engineering Herbicide-Resistant Rice Plants through CRISPR/Cas9-Mediated Homologous Recombination of Acetolactate Synthase. Mol Plant. 2016 Apr. 4; 9(4): 628-31. doi: 10.1016lj.molp.2016.01.001. Epub 2016 Jan. 6), the homologous arm at 350 bp was firstly designed; in order to increase the possibility of homologous replacement, two versions of template donor were designed for each editing vector; the template was directly attached to the editing vector, so that gRNA, Cas9 and the template could enter the same cell simultaneously. Once the cell genomic target DNA was cleaved by Cas9 and gRNA, the template donor DNA could be repaired in time. The other version was free template donor DNA generated by PCR amplification. These additional repair templates were mixed with an editing vector at 20:1 (molar ratio of free repair templates: editing vector), and then bombarded with a gene gun. The length of the core replacement region for the three mutated amino acids 141-342-370 was determined by two selected RNA-targeting cleavage sites (i.e., 1056 bp), the left and right homology arms each were in length of 350 bp, 6 bp was left at each of the left and right ends after cleavage from the vector, and the total length of the template was 1768 bp; in order to facilitate rapid genotyping of PCR product after PCR amplification, the NcoI cleavage site was removed; and in order to avoid re-cleavage after replacement, the PAM (NGG) at the original cleavage site in the template was also removed.

Editing vector: the gRNA1-2 and gRNA2-1 were expressed respectively by rice U3 promoter. The two gRNA expression cassettes were ligated together with a template and sent to GenScript (Nanjing) Co., Ltd. for synthesis. The synthesized DNA fragment was ligated to a skeleton vector pCXUN-Cas9 at KpnI by using seamless cloning technique (from Huazhong Agricultural University and Dr. Yu Bing, Mol Plant. 2016 Apr. 4; 9(4): 628-31. doi: 10.1016/ J.molp.2016.01.001. Epub 2016 Jan. 6) to generate an editing vector.

Transformation by gene gun, screening, differentiation, rooting and soil cultivation of seedlings: the above constructed editing vector was confirmed by sequencing and multi-enzyme cleavages, and was mixed with the free template donor DNA generated by PCR amplification at 20:1 (molar ratio of free repair template: editing vector, molar ratio), and Huaidao No. 5 calli were transformed by gene gun. About 3000 calli were transformed, and transferred to a 50 mg/L hyg screening medium for screening culture to obtain transgenic plants. After three rounds (15 days×3) of screening, the blond calli with good growth state were picked out to differentiate in a differentiation medium, and 0.2 µM tembotrione was added during the differentiation process for screening. After for 3-4 weeks, about 1000 seedlings with around 1 cm were obtained. As to the about 1000 differentiated seedlings, the vast majority of which had been bleached, and only 21 seedlings remained green. The 21 seedlings were transplanted to a rooting medium containing 0.4 µM tembotrione and continuously cultivated so as to promote growth of roots. Two weeks later, 19 seedlings become bleached. The remaining 2 green seedlings (AW2 and AW3) were transplanted to a pot and cultivated in the greenhouse. The photos of the green seedlings taken before transplantation were as shown in FIG. 17A.

Identification of the hppd genotype of edited seedlings: in order to identify the genotype, three pairs of PCR primers were designed to amplify the region of 342-370 mutation sites, the 342-370 region plus a part of the downstream genomic DNA sequence and the 141 single-site, respectively. These primer pairs were: 290-F: AGATACA-GACGTACCTGGACCACCA and 1553-R: GCCGGCAAAAAGGAACTGGG (the region of 342-370 mutation sites); 90-F: AGATACAGACGTACCTGGAC-CACCA and donor-out-R: AGTGATTGTACCATCAT-TTGTC (342-370 region plus a part of the downstream genomic DNA sequences); and 54-F: TTCCAC-CACGTCGAGCTC and 356-R: GGTGAACCCG-GAGATGTACG (141 single-site).

The identification results showed that: the two green seedlings were successfully edited (FIG. 17B). The bands generated by cleaving the PCR product with NcoI enzyme meted with the expectation. The sequencing results also showed that the wild-type histidine His was changed to arginine Arg at position 141 (which codon was changed from CAC to CGC), the wild-type glycine Gly was changed to aspartate Asp at position 342 (which codon was changed from GGC to GAC) and the wild type aspartic acid Asp was changed to asparagine Asn at position 370 (which codon was changed from GAC to AAC).

At the same time, it has been found by many tests that the introduction of the gene of the present invention into a

SEQUENCE LISTING (260 sequences)

SEQ ID NO: 1 - DNA, 1341 bp, Oryza sativa
  The ORF sequence of Wild-Type rice hppd gene (Oshppd_WT)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 2 - protein, 446 aa, Oryza sativa
  The amino acid sequence of Wild-Type rice HPPD protein (OsHPPD _WT)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 3 - DNA, 1341 bp, Artificial Sequence
  Description of Artificial Sequence: Synthetic polynucleotide
  The ORF sequence of rice hppd mutant (Oshppd_A103S)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgctccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcacctccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgcattccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 4 - protein, 446 aa, Artificial Sequence
  Description of Artificial Sequence: Synthetic polypeptide
  The amino acid sequence of rice HPPD mutant (OsHPPD_A103S)
MPPTPTPTATTGAVSAAAAAGENAGFRLVGHRRFVRANPRSDRFQALAFHHVELWCSDAASAAGRFAFALGAPLAARSDLSTGNSAHASLLLRSASVAFLFTSPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 5 - DNA, 1341 bp, Artificial Sequence
  Description of Artificial Sequence: Synthetic polynucleotide
  The ORF sequence of rice hppd mutant(Oshppd_H141R)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 6 - protein, 446 aa, Artificial Sequence
  Description of Artificial Sequence: Synthetic polypeptide
  The amino acid sequence of rice HPPD mutant(OsHPPD_H141R)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 7 - DNA, 1341 bp, Artificial Sequence
  Description of Artificial Sequence: Synthetic polynucleotide
  The ORF sequence of rice hppd mutant(Oshppd_A165V)
atgcctcccactcccacccccaccgccaccaccggcgccgcctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcatgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcaccgcggaccacggcctcgcggtgcacgccgtggcgctgcgcgtcgccgacgcggccgacgccttccgcgccagcgtcgcggccggtgcgcgcccggttttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 8 - protein, 446 aa, Artificial Sequence
  Description of Artificial Sequence: Synthetic polypeptide
  The amino acid sequence of rice HPPD mutant(OsHPPD_A165V)
MPPTPTPTATTGAASAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFTADHGLAVHAVALRVADAADAFRASVAAGARPVFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 9 - DNA, 1341 bp, Artificial Sequence
  Description of Artificial Sequence: Synthetic polynucleotide
  The ORF sequence of rice hppd mutant(Oshppd_V191I)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccactttctcaagctcaagtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcatcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 10 - protein, 446 aa, Artificial Sequence
  Description of Artificial Sequence: Synthetic polypeptide
  The amino acid sequence of rice HPPD mutant(OsHPPD_V191I)
MPPTPTPTATTGAVSAAAAAGENAGFRLVGHRRFVRANPRSDRFQALAFHFLKLKCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFISHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 11 - DNA, 1341 bp, Artificial Sequence
  Description of Artificial Sequence: Synthetic polynucleotide
  The ORF sequence of rice hppd mutant(Oshppd_R220K)
atgcctcccactcccacccccaccgccaccaccggcgccgtctcggccgctgcggcggcgggggagaacgcggggttccgcctcgtcgggcaccaccgcttcgtccgcgccaacccgcggagcgaccggttccaggcgctcgcgttccaccacgtcgagttctggtgcgccgacgccgcgtccgccgcgggccggttcgccttcgccctgggcacgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgcaagttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 12 - protein, 446 aa, Artificial Sequence
  Description of Artificial Sequence: Synthetic polypeptide
  The amino acid sequence of rice HPPD mutant(OsHPPD_R220K)
MPPTPTPTATTGAVSAAAAAGENAGFRLVGHHRFVRANPRSDRFQALAFHHVEFWCADAASAAGRFAFALGTPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRKFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 13 - DNA, 1341 bp, Artificial Sequence
  Description of Artificial Sequence: Synthetic polynucleotide
  The ORF sequence of rice hppd mutant(Oshppd_D370N)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacgacgtgcggcggcgcgccggggacgtgctctcggaggagcagatcaacgagtgccaggagctcggggtgctcgtggacagggataaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 14 - protein, 446 aa, Artificial Sequence
  Description of Artificial Sequence: Synthetic polypeptide
  The amino acid sequence of rice HPPD mutant(OsHPPD_D370N)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDDVRRRAGDVLSEEQINECQELGVLVDRDNQGVLLQIFTKPVGDRPTFFLEMIQRIGCMEKDESGQEYQKGGCGGFGKGNFSELFKSIEEYEKSLEAKQAPTVQGS

SEQ ID NO: 15 - DNA, 1341 bp, Artificial Sequence
  Description of Artificial Sequence: Synthetic polynucleotide
  The ORF sequence of rice hppd mutant(Oshppd_K410I)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagattggcggctgcggcgggtttgggaagggcaacttctcggagctgttcaagtccattgaggagtatgagaaatcccttgaagccaagcaagcccctacagttcaaggatcctag

SEQ ID NO: 16 - protein, 446 aa, Artificial Sequence
  Description of Artificial Sequence: Synthetic polypeptide
  The amino acid sequence of rice HPPD mutant(OsHPPD_K410I)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQIGGCGGFGKGNFSELFKSIEEYEKSLEAKQAPTVQGS

SEQ ID NO: 17 - DNA, 1341 bp, Artificial Sequence
  Description of Artificial Sequence: Synthetic polynucleotide
  The ORF sequence of rice hppd mutant(Oshppd_H141K)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgaaggccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 18 - protein, 446 aa, Artificial Sequence
  Description of Artificial Sequence: Synthetic polypeptide
  The amino acid sequence of rice HPPD mutant(OsHPPD_H141K)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVKAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 19 - DNA, 1341 bp, Artificial Sequence
  Description of Artificial Sequence: Synthetic polynucleotide
  The ORF sequence of rice hppd mutant(Oshppd_H141T)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgaccgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 20 - protein, 446 aa, Artificial Sequence
  Description of Artificial Sequence: Synthetic polypeptide
  The amino acid sequence of rice HPPD mutant(OsHPPD_H141T)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVTAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 21 - DNA, 1341 bp, Artificial Sequence
  Description of Artificial Sequence: Synthetic polynucleotide
  The ORF sequence of rice hppd mutant(Oshppd_G342D)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 22 - protein, 446 aa, Artificial Sequence
  Description of Artificial Sequence: Synthetic polypeptide
  The amino acid sequence of rice HPPD mutant(OsHPPD_G342D)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDDVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 23 - DNA, 1341 bp, Artificial Sequence
  Description of Artificial Sequence: Synthetic polynucleotide
  The ORF sequence of rice hppd mutant(Oshppd_H141R/D370N)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacgacgtgcggcggcgcgccggggacgtgctctcggaggagcagatcaacgagtgccaggagctcggggtgctcgtggacagggataaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 24 - protein, 446 aa, Artificial Sequence
  Description of Artificial Sequence: Synthetic polypeptide
  The amino acid sequence of rice HPPD mutant(OsHPPD_H141R/D370N)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDDVRRRAGDVLSEEQINECQELGVLVDRDNQGVLLQIFTKPVGDRPTFFLEMIQRIGCMEKDESGQEYQKGGCGGFGKGNFSELFKSIEEYEKSLEAKQAPTVQGS

SEQ ID NO: 25 - DNA, 1341 bp, Artificial Sequence
  Description of Artificial Sequence: Synthetic polynucleotide
  The ORF sequence of rice hppd mutant(Oshppd_H141R/G342D)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 26 - protein, 446 aa, Artificial Sequence
  Description of Artificial Sequence: Synthetic polypeptide
  The amino acid sequence of rice HPPD mutant(OsHPPD_H141R/G342D)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDDVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 27 - DNA, 1341 bp, Artificial Sequence; identical to SEQ ID NO: 13
  Description of Artificial Sequence: Synthetic polynucleotide
  The ORF sequence of rice hppd mutant(Oshppd_G342D/D370N)

SEQ ID NO: 28 - protein, 446 aa, Artificial Sequence; identical to SEQ ID NO: 14
  Description of Artificial Sequence: Synthetic polypeptide
  The amino acid sequence of rice HPPD mutant(OsHPPD_G342D/D370N)

SEQ ID NO: 29 - DNA, 1341 bp, Artificial Sequence
  Description of Artificial Sequence: Synthetic polynucleotide
  The ORF sequence of rice hppd mutant(Oshppd_H141R/G342D/D370N)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacgacgtgcggcggcgcgccggggacgtgctctcggaggagcagatcaacgagtgccaggagctcggggtgctcgtggacagggataaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 30 - protein, 446 aa, Artificial Sequence; identical to SEQ ID NO: 24
  Description of Artificial Sequence: Synthetic polypeptide
  The amino acid sequence of rice HPPD mutant(OsHPPD_H141R/G342D/ D370N)

SEQ ID NO: 31 - DNA, 1341 bp, Artificial Sequence
  Description of Artificial Sequence: Synthetic polynucleotide
  The ORF sequence of rice hppd mutant(Oshppd_R93S)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctctcctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 32 - protein, 446 aa, Artificial Sequence
  Description of Artificial Sequence: Synthetic polypeptide
  The amino acid sequence of rice HPPD mutant(OsHPPD_R93S)
MPPTPTPTATTGAVSAAAAAGENAGFRLVGHRRFVRANPRSDRFQALAFHHVELWCADAASAAGRFAFALGAPLAARSDLSTGNSAHASLLLSSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 33 - DNA, 1341 bp, Artificial Sequence
  Description of Artificial Sequence: Synthetic polynucleotide
  The ORF sequence of rice hppd mutant(Oshppd_G226H)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtccacaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 34 - protein, 446 aa, Artificial Sequence
  Description of Artificial Sequence: Synthetic polypeptide
  The amino acid sequence of rice HPPD mutant(OsHPPD_G226H)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVHNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 35 - DNA, 1341 bp, Artificial Sequence
  Description of Artificial Sequence: Synthetic polynucleotide
  The ORF sequence of rice hppd mutant(Oshppd_L276W)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgtggccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 36 - protein, 446 aa, Artificial Sequence
  Description of Artificial Sequence: Synthetic polypeptide
  The amino acid sequence of rice HPPD mutant(OsHPPD_L276W)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLWPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 37 - DNA, 1341 bp, Artificial Sequence
  Description of Artificial Sequence: Synthetic polynucleotide
  The ORF sequence of rice hppd mutant(Oshppd_P277N)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgaatctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 38 - protein, 446 aa, Artificial Sequence
  Description of Artificial Sequence: Synthetic polypeptide
  The amino acid sequence of rice HPPD mutant(OsHPPD_P277N)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLNLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 39 - DNA, 1341 bp, Artificial Sequence
  Description of Artificial Sequence: Synthetic polynucleotide
  The ORF sequence of rice hppd mutant(Oshppd_P336D)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 40 - protein, 446 aa, Artificial Sequence
  Description of Artificial Sequence: Synthetic polypeptide
  The amino acid sequence of rice HPPD mutant(OsHPPD_P336D)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPNYYDGVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 41 - DNA, 1341 bp, Artificial Sequence
  Description of Artificial Sequence: Synthetic polynucleotide
  The ORF sequence of rice hppd mutant(Oshppd_P337A)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccggccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 42 - protein, 446 aa, Artificial Sequence
  Description of Artificial Sequence: Synthetic polypeptide
  The amino acid sequence of rice HPPD mutant(OsHPPD_P337A)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPANYYDGVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 43 - DNA, 1341 bp, Artificial Sequence
  Description of Artificial Sequence: Synthetic polynucleotide
  The ORF sequence of rice hppd mutant(Oshppd_N338D)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 44 - protein, 446 aa, Artificial Sequence
  Description of Artificial Sequence: Synthetic polypeptide
  The amino acid sequence of rice HPPD mutant(OsHPPD_N338D)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPDYYDGVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 45 - DNA, 1341 bp, Artificial Sequence
  Description of Artificial Sequence: Synthetic polynucleotide
  The ORF sequence of rice hppd mutant(Oshppd_N338S)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccagctactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 46 - protein, 446 aa, Artificial Sequence
  Description of Artificial Sequence: Synthetic polypeptide
  The amino acid sequence of rice HPPD mutant(OsHPPD_N338S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPSYYDGVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 47 - DNA, 1341 bp, Artificial Sequence
  Description of Artificial Sequence: Synthetic polynucleotide
  The ORF sequence of rice hppd mutant(Oshppd_N338Y)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgccctactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 48 - protein, 446 aa, Artificial Sequence
  Description of Artificial Sequence: Synthetic polypeptide
  The amino acid sequence of rice HPPD mutant(OsHPPD_N338Y)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPYYYDGVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 49 - DNA, 1341 bp, Artificial Sequence
  Description of Artificial Sequence: Synthetic polynucleotide
  The ORF sequence of rice hppd mutant(Oshppd_R346C)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggtgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 50 - protein, 446 aa, Artificial Sequence
  Description of Artificial Sequence: Synthetic polypeptide
  The amino acid sequence of rice HPPD mutant(OsHPPD_R346C)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRCAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 51 - DNA, 1341 bp, Artificial Sequence
  Description of Artificial Sequence: Synthetic polynucleotide
  The ORF sequence of rice hppd mutant(Oshppd_R346H)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcacgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 52 - protein, 446 aa, Artificial Sequence
  Description of Artificial Sequence: Synthetic polypeptide
  The amino acid sequence of rice HPPD mutant(OsHPPD_R346H)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRHAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 53 - DNA, 1341 bp, Artificial Sequence
  Description of Artificial Sequence: Synthetic polynucleotide
  The ORF sequence of rice hppd mutant(Oshppd_R346S)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggagcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 54 - protein, 446 aa, Artificial Sequence
  Description of Artificial Sequence: Synthetic polypeptide
  The amino acid sequence of rice HPPD mutant(OsHPPD_R346S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRSAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 55 - DNA, 1341 bp, Artificial Sequence
  Description of Artificial Sequence: Synthetic polynucleotide
  The ORF sequence of rice hppd mutant(Oshppd_R346D)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcgggacgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 56 - protein, 446 aa, Artificial Sequence
  Description of Artificial Sequence: Synthetic polypeptide
  The amino acid sequence of rice HPPD mutant(OsHPPD_R346D)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRDAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 57 - DNA, 1341 bp, Artificial Sequence
  Description of Artificial Sequence: Synthetic polynucleotide
  The ORF sequence of rice hppd mutant(Oshppd_R346Y)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggtacgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 58 - protein, 446 aa, Artificial Sequence
  Description of Artificial Sequence: Synthetic polypeptide
  The amino acid sequence of rice HPPD mutant(OsHPPD_R346Y)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRYAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 59 - DNA, 1341 bp, Artificial Sequence
  Description of Artificial Sequence: Synthetic polynucleotide
  The ORF sequence of rice hppd mutant(Oshppd_I377C)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagtgcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 60 - protein, 446 aa, Artificial Sequence
  Description of Artificial Sequence: Synthetic polypeptide
  The amino acid sequence of rice HPPD mutant(OsHPPD_I377C)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQCFTKPVGDRPTFFLEMIQRIGCMEKDESGQEYQKGGCGGFGKGNFSELFKSIEEYEKSLEAKQAPTVQGS

SEQ ID NO: 61 - DNA, 1341 bp, Artificial Sequence
  Description of Artificial Sequence: Synthetic polynucleotide
  The ORF sequence of rice hppd mutant(Oshppd_P386T)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggacaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 62 - protein, 446 aa, Artificial Sequence
  Description of Artificial Sequence: Synthetic polypeptide
  The amino acid sequence of rice HPPD mutant(OsHPPD_P386T)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRTTFFLEMIQRIGCMEKDESGQEYQKGGCGGFGKGNFSELFKSIEEYEKSLEAKQAPTVQGS

SEQ ID NO: 63 - DNA, 1341 bp, Artificial Sequence
  Description of Artificial Sequence: Synthetic polynucleotide
  The ORF sequence of rice hppd mutant(Oshppd_L390I)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcattgagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 64 - protein, 446 aa, Artificial Sequence
  Description of Artificial Sequence: Synthetic polypeptide
  The amino acid sequence of rice HPPD mutant(OsHPPD_L390I)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFIEMIQRIGCMEKDESGQEYQKGGCGGFGKGNFSELFKSIEEYEKSLEAKQAPTVQGS

SEQ ID NO: 65 - DNA, 1341 bp, Artificial Sequence
  Description of Artificial Sequence: Synthetic polynucleotide
  The ORF sequence of rice hppd mutant(Oshppd_M392L)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagctgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 66 - protein, 446 aa, Artificial Sequence
  Description of Artificial Sequence: Synthetic polypeptide
  The amino acid sequence of rice HPPD mutant(OsHPPD_M392L)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLELIQRIGCMEKDESGQEYQKGGCGGFGKGNFSELFKSIEEYEKSLEAKQAPTVQGS

SEQ ID NO: 67 - DNA, 1341 bp, Artificial Sequence
  Description of Artificial Sequence: Synthetic polynucleotide
  The ORF sequence of rice hppd mutant(Oshppd_K418P)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggccgggcaacttctcggagctgttcaagtccattgaggagtatgagaaatcccttgaagccaagcaagcccctacagttcaaggatcctag

SEQ ID NO: 68 - protein, 446 aa, Artificial Sequence
  Description of Artificial Sequence: Synthetic polypeptide
  The amino acid sequence of rice HPPD mutant(OsHPPD_K418P)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGPGNFSELFKSIEEYEKSLEAKQAPTVQGS

SEQ ID NO: 69 - DNA, 1341 bp, Artificial Sequence
  Description of Artificial Sequence: Synthetic polynucleotide
  The ORF sequence of rice hppd mutant(Oshppd_G419F)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagttcaacttctcggagctgttcaagtccattgaggagtatgagaaatcccttgaagccaagcaagcccctacagttcaaggatcctag

SEQ ID NO: 70 - protein, 446 aa, Artificial Sequence
  Description of Artificial Sequence: Synthetic polypeptide
  The amino acid sequence of rice HPPD mutant(OsHPPD_G419F)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGKFNFSELFKSIEEYEKSLEAKQAPTVQGS

SEQ ID NO: 71 - DNA, 1341 bp, Artificial Sequence
  Description of Artificial Sequence: Synthetic polynucleotide
  The ORF sequence of rice hppd mutant(Oshppd_G419L)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagttgaacttctcggagctgttcaagtccattgaggagtatgagaaatcccttgaagccaagcaagcccctacagttcaaggatcctag

SEQ ID NO: 72 - protein, 446 aa, Artificial Sequence
  Description of Artificial Sequence: Synthetic polypeptide
  The amino acid sequence of rice HPPD mutant(OsHPPD_G419L)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGKLNFSELFKSIEEYEKSLEAKQAPTVQGS

SEQ ID NO: 73 - DNA, 1341 bp, Artificial Sequence
  Description of Artificial Sequence: Synthetic polynucleotide
  The ORF sequence of rice hppd mutant(Oshppd_G419V)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaaggtgaacttctcggagctgttcaagtccattgaggagtatgagaaatcccttgaagccaagcaagcccctacagttcaaggatcctag

SEQ ID NO: 74 - protein, 446 aa, Artificial Sequence
  Description of Artificial Sequence: Synthetic polypeptide
  The amino acid sequence of rice HPPD mutant(OsHPPD_G419V)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGKVNFSELFKSIEEYEKSLEAKQAPTVQGS

SEQ ID NO: 75 - DNA, 1341 bp, Artificial Sequence
  Description of Artificial Sequence: Synthetic polynucleotide
  The ORF sequence of rice hppd mutant(Oshppd_N420S)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcagcttctcggagctgttcaagtccattgaggagtatgagaaatcccttgaagccaagcaagcccctacagttcaaggatcctag

SEQ ID NO: 76 - protein, 446 aa, Artificial Sequence
  Description of Artificial Sequence: Synthetic polypeptide
  The amino acid sequence of rice HPPD mutant(OsHPPD_N420S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGKGSFSELFKSIEEYEKSLEAKQAPTVQGS

SEQ ID NO: 77 - DNA, 1341 bp, Artificial Sequence
  Description of Artificial Sequence: Synthetic polynucleotide
  The ORF sequence of rice hppd mutant(Oshppd_N420T)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaccttctcggagctgttcaagtccattgaggagtatgagaaatcccttgaagccaagcaagcccctacagttcaaggatcctag

SEQ ID NO: 78 - protein, 446 aa, Artificial Sequence
  Description of Artificial Sequence: Synthetic polypeptide
  The amino acid sequence of rice HPPD mutant(OsHPPD_N420T)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGKGTFSELFKSIEEYEKSLEAKQAPTVQGS

SEQ ID NO: 79 - DNA, 1341 bp, Artificial Sequence
  Description of Artificial Sequence: Synthetic polynucleotide
  The ORF sequence of rice hppd mutant(Oshppd_E403G)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgggagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 80 - protein, 446 aa, Artificial Sequence
  Description of Artificial Sequence: Synthetic polypeptide
  The amino acid sequence of rice HPPD mutant(OsHPPD_E403G)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDGSGQEYQKGGCGGFGKGNFSELFKSIEEYEKSLEAKQAPTVQGS

SEQ ID NO: 81 - DNA, 1341 bp, Artificial Sequence
  Description of Artificial Sequence: Synthetic polynucleotide
  The ORF sequence of rice hppd mutant(Oshppd_E430G)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggggtatgagaaatcccttgaagccaagcaagcccctacagttcaaggatcctag

SEQ ID NO: 82 - protein, 446 aa, Artificial Sequence
  Description of Artificial Sequence: Synthetic polypeptide
  The amino acid sequence of rice HPPD mutant(OsHPPD_E430G)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGKGNFSELFKSIEGYEKSLEAKQAPTVQGS

SEQ ID NO: 83 - DNA, 1341 bp, Artificial Sequence
  Description of Artificial Sequence: Synthetic polynucleotide
  The ORF sequence of rice hppd mutant(Oshppd_Y431L)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagttggagaaatcccttgaagccaagcaagcccctacagttcaaggatcctag

SEQ ID NO: 84 - protein, 446 aa, Artificial Sequence
  Description of Artificial Sequence: Synthetic polypeptide
  The amino acid sequence of rice HPPD mutant(OsHPPD_Y431L)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGKGNFSELFKSIEELEKSLEAKQAPTVQGS

SEQ ID NO: 85 - DNA, 1341 bp, Artificial Sequence
  Description of Artificial Sequence: Synthetic polynucleotide
  The ORF sequence of rice hppd mutant(Oshppd_H141R/N338D)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 86 - protein, 446 aa, Artificial Sequence
  Description of Artificial Sequence: Synthetic polypeptide
  The amino acid sequence of rice HPPD mutant(OsHPPD_H141R/N338D)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPDYYDGVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 87 - DNA, 1341 bp, Artificial Sequence; identical to SEQ ID NO: 25
  Description of Artificial Sequence: Synthetic polynucleotide
  The ORF sequence of rice hppd mutant(Oshppd_H141R/G342D)

SEQ ID NO: 88 - protein, 446 aa, Artificial Sequence; identical to SEQ ID NO: 26
  Description of Artificial Sequence: Synthetic polypeptide
  The amino acid sequence of rice HPPD mutant(OsHPPD_H141R/G342D)

SEQ ID NO: 89 - DNA, 1341 bp, Artificial Sequence
  Description of Artificial Sequence: Synthetic polynucleotide
  The ORF sequence of rice hppd mutant(Oshppd_N338D/G342D)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 90 - protein, 446 aa, Artificial Sequence
  Description of Artificial Sequence: Synthetic polypeptide
  The amino acid sequence of rice HPPD mutant(OsHPPD_N338D/G342D)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPDYYDDVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 91 - DNA, 1341 bp, Artificial Sequence
  Description of Artificial Sequence: Synthetic polynucleotide
  The ORF sequence of rice hppd mutant(Oshppd_K418P/G419F)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggccgttcaacttctcggagctgttcaagtccattgaggagtatgagaaatcccttgaagccaagcaagcccctacagttcaaggatcctag

SEQ ID NO: 92 - protein, 446 aa, Artificial Sequence
  Description of Artificial Sequence: Synthetic polypeptide
  The amino acid sequence of rice HPPD mutant(OsHPPD_K418P/G419F)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGPFNFSELFKSIEEYEKSLEAKQAPTVQGS

SEQ ID NO: 93 - DNA, 1341 bp, Artificial Sequence
  Description of Artificial Sequence: Synthetic polynucleotide
  The ORF sequence of rice hppd mutant(Oshppd_G419F/N420S)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagttcagcttctcggagctgttcaagtccattgaggagtatgagaaatcccttgaagccaagcaagcccctacagttcaaggatcctag

SEQ ID NO: 94 - protein, 446 aa, Artificial Sequence
  Description of Artificial Sequence: Synthetic polypeptide
  The amino acid sequence of rice HPPD mutant(OsHPPD_G419F/N420S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGKFSFSELFKSIEEYEKSLEAKQAPTVQGS

SEQ ID NO: 95 - DNA, 1341 bp, Artificial Sequence
  Description of Artificial Sequence: Synthetic polynucleotide
  The ORF sequence of rice hppd mutant(Oshppd_G342D/R346C)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacgacgtgcggcggtgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 96 - protein, 446 aa, Artificial Sequence
  Description of Artificial Sequence: Synthetic polypeptide
  The amino acid sequence of rice HPPD mutant(OsHPPD_G342D/R346C)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDDVRRCAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 97 - DNA, 1341 bp, Artificial Sequence
  Description of Artificial Sequence: Synthetic polynucleotide
  The ORF sequence of rice hppd mutant(Oshppd_G342D/R346H)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacgacgtgcggcggcacgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 98 - protein, 446 aa, Artificial Sequence
  Description of Artificial Sequence: Synthetic polypeptide
  The amino acid sequence of rice HPPD mutant(OsHPPD_G342D/R346H)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDDVRRHAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 99 - DNA, 1341 bp, Artificial Sequence
  Description of Artificial Sequence: Synthetic polynucleotide
  The ORF sequence of rice hppd mutant(Oshppd_H141R/N420S)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcagcttctcggagctgttcaagtccattgaggagtatgagaaatcccttgaagccaagcaagcccctacagttcaaggatcctag

SEQ ID NO: 100 - protein, 446 aa, Artificial Sequence
  Description of Artificial Sequence: Synthetic polypeptide
  The amino acid sequence of rice HPPD mutant(OsHPPD_H141R/N420S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGKGSFSELFKSIEEYEKSLEAKQAPTVQGS

SEQ ID NO: 101 - DNA, 1341 bp, Artificial Sequence
  Description of Artificial Sequence: Synthetic polynucleotide
  The ORF sequence of rice hppd mutant(Oshppd_G338D/K418P)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggccgggcaacttctcggagctgttcaagtccattgaggagtatgagaaatcccttgaagccaagcaagcccctacagttcaaggatcctag

SEQ ID NO: 102 - protein, 446 aa, Artificial Sequence
  Description of Artificial Sequence: Synthetic polypeptide
  The amino acid sequence of rice HPPD mutant(OsHPPD_G338D/K418P)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPDYYDGVRRRAGDVLSEEQINECQELGVLVDRDDQGVLLQIFTKPVGDRPTFFLEMIQRIGCMEKDESGQEYQKGGCGGFGPGNFSELFKSIEEYEKSLEAKQAPTVQGS

SEQ ID NO: 103 - DNA, 1341 bp, Artificial Sequence
  Description of Artificial Sequence: Synthetic polynucleotide
  The ORF sequence of rice hppd mutant(Oshppd_P277N/N338D)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgaatctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 104 - protein, 446 aa, Artificial Sequence
  Description of Artificial Sequence: Synthetic polypeptide
  The amino acid sequence of rice HPPD mutant(OsHPPD_P277N/N338D)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLNLNEPVHGTKRRSQIQTYLDHHGGPGVQHIALASDDVLGTLREMRARSAMGGFEFLAPPPPDYYDGVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 105 - DNA, 1341 bp, Artificial Sequence
  Description of Artificial Sequence: Synthetic polynucleotide
  The ORF sequence of rice hppd mutant(Oshppd_L276W/P277N)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgtggaatctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 106 - protein, 446 aa, Artificial Sequence
  Description of Artificial Sequence: Synthetic polypeptide
  The amino acid sequence of rice HPPD mutant(OsHPPD_L276W/P277N)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLWNLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 107 - DNA, 1341 bp, Artificial Sequence
  Description of Artificial Sequence: Synthetic polynucleotide
  The ORF sequence of rice hppd mutant(Oshppd_H141R/N338D/G342D)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 108 - protein, 446 aa, Artificial Sequence
  Description of Artificial Sequence: Synthetic polypeptide
  The amino acid sequence of rice HPPD mutant(OsHPPD_H141R/N338D/ G342D)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPDYYDDVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 109 - DNA, 1341 bp, Artificial Sequence
  Description of Artificial Sequence: Synthetic polynucleotide
  The ORF sequence of rice hppd mutant(Oshppd_H141R/G342D/K418P)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggccgggcaacttctcggagctgttcaagtccattgaggagtatgagaaatcccttgaagccaagcaagcccctacagttcaaggatcctag

SEQ ID NO: 110 - protein, 446 aa, Artificial Sequence
  Description of Artificial Sequence: Synthetic polypeptide
  The amino acid sequence of rice HPPD mutant(OsHPPD_H141R/G342D/ K418P)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDDVRRRAGDVLSEEQINECQELGVLVDRDDQGVLLQIFTKPVGDRPTFFLEMIQRIGCMEKDESGQEYQKGGCGGFGPGNFSELFKSIEEYEKSLEAKQAPTVQGS

SEQ ID NO: 111 - DNA, 1341 bp, Artificial Sequence
  Description of Artificial Sequence: Synthetic polynucleotide
  The ORF sequence of rice hppd mutant(Oshppd_H141R/G342D/G419F)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagttcaacttctcggagctgttcaagtccattgaggagtatgagaaatcccttgaagccaagcaagcccctacagttcaaggatcctag

SEQ ID NO: 112 - protein, 446 aa, Artificial Sequence
  Description of Artificial Sequence: Synthetic polypeptide
  The amino acid sequence of rice HPPD mutant(OsHPPD_H141R/G342D/ G419F)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDDVRRRAGDVLSEEQINECQELGVLVDRDDQGVLLQIFTKPVGDRPTFFLEMIQRIGCMEKDESGQEYQKGGCGGFGKFNFSELFKSIEEYEKSLEAKQAPTVQGS

SEQ ID NO: 113 - DNA, 1341 bp, Artificial Sequence
  Description of Artificial Sequence: Synthetic polynucleotide
  The ORF sequence of rice hppd mutant(Oshppd_H141R/G342D/P386T)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggacaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 114 - protein, 446 aa, Artificial Sequence
  Description of Artificial Sequence: Synthetic polypeptide
  The amino acid sequence of rice HPPD mutant(OsHPPD_H141R/G342D/ P386T)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDDVRRRAGDVLSEEQINECQELGVLVDRDDQGVLLQIFTKPVGDRTTFFLEMIQRIGCMEKDESGQEYQKGGCGGFGKGNFSELFKSIEEYEKSLEAKQAPTVQGS

SEQ ID NO: 115 - DNA, 1341 bp, Artificial Sequence
  Description of Artificial Sequence: Synthetic polynucleotide
  The ORF sequence of rice hppd mutant(Oshppd_K418P/G419F/N420T)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggccgttcaccttctcggagctgttcaagtccattgaggagtatgagaaatcccttgaagccaagcaagcccctacagttcaaggatcctag

SEQ ID NO: 116 - protein, 446 aa, Artificial Sequence
  Description of Artificial Sequence: Synthetic polypeptide
  The amino acid sequence of rice HPPD mutant(OsHPPD_K418P/G419F/ N420T)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGPFTFSELFKSIEEYEKSLEAKQAPTVQGS

SEQ ID NO: 117 - DNA, 1341 bp, Artificial Sequence
  Description of Artificial Sequence: Synthetic polynucleotide
  The ORF sequence of rice hppd mutant(Oshppd_K418T/G419F/N420T)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaccttcaccttctcggagctgttcaagtccattgaggagtatgagaaatcccttgaagccaagcaagcccctacagttcaaggatcctag

SEQ ID NO: 118 - protein, 446 aa, Artificial Sequence
  Description of Artificial Sequence: Synthetic polypeptide
  The amino acid sequence of rice HPPD mutant(OsHPPD_K418T/G419F/ N420T)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGTFTFSELFKSIEEYEKSLEAKQAPTVQGS

SEQ ID NO: 119 - DNA, 1341 bp, Artificial Sequence
  Description of Artificial Sequence: Synthetic polynucleotide
  The ORF sequence of rice hppd mutant(Oshppd_H141R/G342D/R346C)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacgacgtgcggcggtgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 120 - protein, 446 aa, Artificial Sequence
  Description of Artificial Sequence: Synthetic polypeptide
  The amino acid sequence of rice HPPD mutant(OsHPPD_H141R/G342D/ R346C)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDDVRRCAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 121 - DNA, 1341 bp, Artificial Sequence
  Description of Artificial Sequence: Synthetic polynucleotide
  The ORF sequence of rice hppd mutant(Oshppd_H141R/G342D/R346H)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacgacgtgcggcggcacgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 122 - protein, 446 aa, Artificial Sequence
  Description of Artificial Sequence: Synthetic polypeptide
  The amino acid sequence of rice HPPD mutant(OsHPPD_H141R/G342D/ R346H)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDDVRRHAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 123 - DNA, 1341 bp, Artificial Sequence
  Description of Artificial Sequence: Synthetic polynucleotide
  The ORF sequence of rice hppd mutant(Oshppd_H141R/G342D/N420S)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcagcttctcggagctgttcaagtccattgaggagtatgagaaatcccttgaagccaagcaagcccctacagttcaaggatcctag

SEQ ID NO: 124 - protein, 446 aa, Artificial Sequence
  Description of Artificial Sequence: Synthetic polypeptide
  The amino acid sequence of rice HPPD mutant(OsHPPD_H141R/G342D/ N420S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDDVRRRAGDVLSEEQINECQELGVLVDRDDQGVLLQIFTKPVGDRPTFFLEMIQRIGCMEKDESGQEYQKGGCGGFGKGSFSELFKSIEEYEKSLEAKQAPTVQGS

SEQ ID NO: 125 - DNA, 1341 bp, Artificial Sequence
  Description of Artificial Sequence: Synthetic polynucleotide
  The ORF sequence of rice hppd mutant(Oshppd_H141R/G342D/P277N)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgaatctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 126 - protein, 446 aa, Artificial Sequence
  Description of Artificial Sequence: Synthetic polypeptide
  The amino acid sequence of rice HPPD mutant(OsHPPD_H141R/G342D/ P277N)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLNLNEPVHGTKRRSQIQTYLDHHGGPGVQHIALASDDVLGTLREMRARSAMGGFEFLAPPPPNYYDDVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 127 - DNA, 1341 bp, Artificial Sequence
  Description of Artificial Sequence: Synthetic polynucleotide
  The ORF sequence of rice hppd mutant(Oshppd_H141R/G342D/P336D)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatcccaactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 128 - protein, 446 aa, Artificial Sequence
  Description of Artificial Sequence: Synthetic polypeptide
  The amino acid sequence of rice HPPD mutant(OsHPPD_H141R/G342D/ P336D)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPNYYDDVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 129 - DNA, 1341 bp, Artificial Sequence
  Description of Artificial Sequence: Synthetic polynucleotide
  The ORF sequence of rice hppd mutant(Oshppd_H141R/G342D/L276W)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgtggccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 130 - protein, 446 aa, Artificial Sequence
  Description of Artificial Sequence: Synthetic polypeptide
  The amino acid sequence of rice HPPD mutant(OsHPPD_H141R/G342D/ L276W)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLWPLNEPVHGTKRRSQIQTYLDHHGGPGVQHIALASDDVLGTLREMRARSAMGGFEFLAPPPPNYYDDVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 131 - DNA, 1341 bp, Artificial Sequence
  Description of Artificial Sequence: Synthetic polynucleotide
  The ORF sequence of rice hppd mutant(Oshppd_H141R/G342D/R346S)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacgacgtgcggcggagcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 132 - protein, 446 aa, Artificial Sequence
  Description of Artificial Sequence: Synthetic polypeptide
  The amino acid sequence of rice HPPD mutant(OsHPPD_H141R/G342D/ R346S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDDVRRSAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 133 - DNA, 1341 bp, Artificial Sequence
  Description of Artificial Sequence: Synthetic polynucleotide
  The ORF sequence of rice hppd mutant(Oshppd_H141R/G342D/L390I)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcattgagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 134 - protein, 446 aa, Artificial Sequence
  Description of Artificial Sequence: Synthetic polypeptide
  The amino acid sequence of rice HPPD mutant(OsHPPD_H141R/G342D/ L390I)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDDVRRRAGDVLSEEQINECQELGVLVDRDDQGVLLQIFTKPVGDRPTFFIEMIQRIGCMEKDESGQEYQKGGCGGFGKGNFSELFKSIEEYEKSLEAKQAPTVQGS

SEQ ID NO: 135 - DNA, 1341 bp, Artificial Sequence
  Description of Artificial Sequence: Synthetic polynucleotide
  The ORF sequence of rice hppd mutant(Oshppd_H141R/G342D/I377C)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacgacgtgcggcggcgcgccggggacgtgctctcggaggagcagatcaacgagtgccaggagctcggggtgctcgtggacagggatgaccagggggtgttgctccagtgcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 136 - protein, 446 aa, Artificial Sequence
  Description of Artificial Sequence: Synthetic polypeptide
  The amino acid sequence of rice HPPD mutant(OsHPPD_H141R/G342D/ I377C)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDDVRRRAGDVLSEEQINECQELGVLVDRDDQGVLLQCFTKPVGDRPTFFLEMIQRIGCMEKDESGQEYQKGGCGGFGKGNFSELFKSIEEYEKSLEAKQAPTVQGS

SEQ ID NO: 137 - DNA, 1341 bp, Artificial Sequence
  Description of Artificial Sequence: Synthetic polynucleotide
  The ORF sequence of rice hppd mutant(Oshppd_H141R/G342D/M392L)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagctgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 138 - protein, 446 aa, Artificial Sequence
  Description of Artificial Sequence: Synthetic polypeptide
  The amino acid sequence of rice HPPD mutant(OsHPPD_H141R/G342D/ M392L)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDDVRRRAGDVLSEEQINECQELGVLVDRDDQGVLLQIFTKPVGDRPTFFLELIQRIGCMEKDESGQEYQKGGCGGFGKGNFSELFKSIEEYEKSLEAKQAPTVQGS

SEQ ID NO: 139 - DNA, 1341 bp, Artificial Sequence
  Description of Artificial Sequence: Synthetic polynucleotide
  The ORF sequence of rice hppd mutant(Oshppd_H141R/P337A/G342D)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccggccaactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 140 - protein, 446 aa, Artificial Sequence
  Description of Artificial Sequence: Synthetic polypeptide
  The amino acid sequence of rice HPPD mutant(OsHPPD_H141R/P337A/ G342D)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPANYYDDVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 141 - DNA, 1341 bp, Artificial Sequence
  Description of Artificial Sequence: Synthetic polynucleotide
  The ORF sequence of rice hppd mutant(Oshppd_H141R/N338S/G342D)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccagctactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 142 - protein, 446 aa, Artificial Sequence
  Description of Artificial Sequence: Synthetic polypeptide
  The amino acid sequence of rice HPPD mutant(OsHPPD_H141R/N338S/ G342D)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPSYYDDVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 143 - DNA, 1341 bp, Artificial Sequence
  Description of Artificial Sequence: Synthetic polynucleotide
  The ORF sequence of rice hppd mutant(Oshppd_H141R/N338Y/G342D)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgccctactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 144 - protein, 446 aa, Artificial Sequence
  Description of Artificial Sequence: Synthetic polypeptide
  The amino acid sequence of rice HPPD mutant(OsHPPD_H141R/N338Y/ G342D)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPYYYDDVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 145 - DNA, 1341 bp, Artificial Sequence
  Description of Artificial Sequence: Synthetic polynucleotide
  The ORF sequence of rice hppd mutant(Oshppd_P277N/N338D/G342D)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgaatctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 146 - protein, 446 aa, Artificial Sequence
  Description of Artificial Sequence: Synthetic polypeptide
  The amino acid sequence of rice HPPD mutant(OsHPPD_P277N/N338D/ G342D)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLNLNEPVHGTKRRSQIQTYLDHHGGPGVQHIALASDDVLGTLREMRARSAMGGFEFLAPPPPDYYDDVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 147 - DNA, 1341 bp, Artificial Sequence
  Description of Artificial Sequence: Synthetic polynucleotide
  The ORF sequence of rice hppd mutant(Oshppd_P277N/G342D/R346C)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgaatctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacgacgtgcggcggtgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 148 - protein, 446 aa, Artificial Sequence
  Description of Artificial Sequence: Synthetic polypeptide
  The amino acid sequence of rice HPPD mutant(OsHPPD_P277N/G342D/ R346C)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLNLNEPVHGTKRRSQIQTYLDHHGGPGVQHIALASDDVLGTLREMRARSAMGGFEFLAPPPPNYYDDVRRCAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 149 - DNA, 1341 bp, Artificial Sequence
  Description of Artificial Sequence: Synthetic polynucleotide
  The ORF sequence of rice hppd mutant(Oshppd_P277N/N338D/N420S)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgaatctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcagcttctcggagctgttcaagtccattgaggagtatgagaaatcccttgaagccaagcaagcccctacagttcaaggatcctag

SEQ ID NO: 150 - protein, 446 aa, Artificial Sequence
  Description of Artificial Sequence: Synthetic polypeptide
  The amino acid sequence of rice HPPD mutant(OsHPPD_P277N/N338D/ N420S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLNLNEPVHGTKRRSQIQTYLDHHGGPGVQHIALASDDVLGTLREMRARSAMGGFEFLAPPPPDYYDGVRRRAGDVLSEEQINECQELGVLVDRDDQGVLLQIFTKPVGDRPTFFLEMIQRIGCMEKDESGQEYQKGGCGGFGKGSFSELFKSIEEYEKSLEAKQAPTVQGS

SEQ ID NO: 151 - DNA, 1341 bp, Artificial Sequence
  Description of Artificial Sequence: Synthetic polynucleotide
  The ORF sequence of rice hppd mutant(Oshppd_N338D/G342D/K418P)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggccgggcaacttctcggagctgttcaagtccattgaggagtatgagaaatcccttgaagccaagcaagcccctacagttcaaggatcctag

SEQ ID NO: 152 - protein, 446 aa, Artificial Sequence
  Description of Artificial Sequence: Synthetic polypeptide
  The amino acid sequence of rice HPPD mutant(OsHPPD_N338D/G342D/ K418P)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPDYYDDVRRRAGDVLSEEQINECQELGVLVDRDDQGVLLQIFTKPVGDRPTFFLEMIQRIGCMEKDESGQEYQKGGCGGFGPGNFSELFKSIEEYEKSLEAKQAPTVQGS

SEQ ID NO: 153 - DNA, 1341 bp, Artificial Sequence
  Description of Artificial Sequence: Synthetic polynucleotide
  The ORF sequence of rice hppd mutant(Oshppd_H141R/N338D/N420S)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcagcttctcggagctgttcaagtccattgaggagtatgagaaatcccttgaagccaagcaagcccctacagttcaaggatcctag

SEQ ID NO: 154 - protein, 446 aa, Artificial Sequence
  Description of Artificial Sequence: Synthetic polypeptide
  The amino acid sequence of rice HPPD mutant(OsHPPD_H141R/N338D/ N420S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPDYYDGVRRRAGDVLSEEQINECQELGVLVDRDDQGVLLQIFTKPVGDRPTFFLEMIQRIGCMEKDESGQEYQKGGCGGFGKGSFSELFKSIEEYEKSLEAKQAPTVQGS

SEQ ID NO: 155 - DNA, 1341 bp, Artificial Sequence
  Description of Artificial Sequence: Synthetic polynucleotide
  The ORF sequence of rice hppd mutant(Oshppd_H141R/N338S/N420S)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccagctactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcagcttctcggagctgttcaagtccattgaggagtatgagaaatcccttgaagccaagcaagcccctacagttcaaggatcctag

SEQ ID NO: 156 - protein, 446 aa, Artificial Sequence
  Description of Artificial Sequence: Synthetic polypeptide
  The amino acid sequence of rice HPPD mutant(OsHPPD_H141R/N338S/ N420S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPSYYDGVRRRAGDVLSEEQINECQELGVLVDRDDQGVLLQIFTKPVGDRPTFFLEMIQRIGCMEKDESGQEYQKGGCGGFGKGSFSELFKSIEEYEKSLEAKQAPTVQGS

SEQ ID NO: 157 - DNA, 1341 bp, Artificial Sequence
  Description of Artificial Sequence: Synthetic polynucleotide
  The ORF sequence of rice hppd mutant(Oshppd_H141R/N338D/G342D/ K418P)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggccgggcaacttctcggagctgttcaagtccattgaggagtatgagaaatcccttgaagccaagcaagcccctacagttcaaggatcctag

SEQ ID NO: 158 - protein, 446 aa, Artificial Sequence
  Description of Artificial Sequence: Synthetic polypeptide
  The amino acid sequence of rice HPPD mutant(OsHPPD_H141R/N338D/ G342D/K418P)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPDYYDDVRRRAGDVLSEEQINECQELGVLVDRDDQGVLLQIFTKPVGDRPTFFLEMIQRIGCMEKDESGQEYQKGGCGGFGPGNFSELFKSIEEYEKSLEAKQAPTVQGS

SEQ ID NO: 159 - DNA, 1341 bp, Artificial Sequence
  Description of Artificial Sequence: Synthetic polynucleotide
  The ORF sequence of rice hppd mutant(Oshppd_H141R/N338D/G342D/ G419F)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagttcaacttctcggagctgttcaagtccattgaggagtatgagaaatcccttgaagccaagcaagcccctacagttcaaggatcctag

SEQ ID NO: 160 - protein, 446 aa, Artificial Sequence
  Description of Artificial Sequence: Synthetic polypeptide
  The amino acid sequence of rice HPPD mutant(OsHPPD_H141R/N338D/ G342D/G419F)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPDYYDDVRRRAGDVLSEEQINECQELGVLVDRDDQGVLLQIFTKPVGDRPTFFLEMIQRIGCMEKDESGQEYQKGGCGGFGKFNFSELFKSIEEYEKSLEAKQAPTVQGS

SEQ ID NO: 161 - DNA, 1341 bp, Artificial Sequence
  Description of Artificial Sequence: Synthetic polynucleotide
  The ORF sequence of rice hppd mutant(Oshppd_H141R/N338D/G342D/ P386T)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggacaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 162 - protein, 446 aa, Artificial Sequence
  Description of Artificial Sequence: Synthetic polypeptide
  The amino acid sequence of rice HPPD mutant(OsHPPD_H141R/N338D/ G342D/P386T)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPDYYDDVRRRAGDVLSEEQINECQELGVLVDRDDQGVLLQIFTKPVGDRTTFFLEMIQRIGCMEKDESGQEYQKGGCGGFGKGNFSELFKSIEEYEKSLEAKQAPTVQGS

SEQ ID NO: 163 - DNA, 1341 bp, Artificial Sequence
  Description of Artificial Sequence: Synthetic polynucleotide
  The ORF sequence of rice hppd mutant(Oshppd_H141R/N338D/G342D/ R346C)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacgacgtgcggcggtgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 164 - protein, 446 aa, Artificial Sequence
  Description of Artificial Sequence: Synthetic polypeptide
  The amino acid sequence of rice HPPD mutant(OsHPPD_H141R/N338D/ G342D/R346C)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPDYYDDVRRCAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 165 - DNA, 1341 bp, Artificial Sequence
  Description of Artificial Sequence: Synthetic polynucleotide
  The ORF sequence of rice hppd mutant(Oshppd_H141R/N338D/G342D/ R346H)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacgacgtgcggcggcacgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 166 - protein, 446 aa, Artificial Sequence
  Description of Artificial Sequence: Synthetic polypeptide
  The amino acid sequence of rice HPPD mutant(OsHPPD_H141R/N338D/ G342D/R346H)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPDYYDDVRRHAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 167 - DNA, 1341 bp, Artificial Sequence
  Description of Artificial Sequence: Synthetic polynucleotide
  The ORF sequence of rice hppd mutant(Oshppd_H141R/G342D/K418P/ G419F)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggccgttcaacttctcggagctgttcaagtccattgaggagtatgagaaatcccttgaagccaagcaagcccctacagttcaaggatcctag

SEQ ID NO: 168 - protein, 446 aa, Artificial Sequence
  Description of Artificial Sequence: Synthetic polypeptide
  The amino acid sequence of rice HPPD mutant(OsHPPD_H141R/G342D/ K418P/G419F)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDDVRRRAGDVLSEEQINECQELGVLVDRDDQGVLLQIFTKPVGDRPTFFLEMIQRIGCMEKDESGQEYQKGGCGGFGPFNFSELFKSIEEYEKSLEAKQAPTVQGS

SEQ ID NO: 169 - DNA, 1341 bp, Artificial Sequence
  Description of Artificial Sequence: Synthetic polynucleotide
  The ORF sequence of rice hppd mutant(Oshppd_H141R/G342D/L276W/ P277N)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgtggaatctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccaactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 170 - protein, 446 aa, Artificial Sequence
  Description of Artificial Sequence: Synthetic polypeptide
  The amino acid sequence of rice HPPD mutant(OsHPPD_H141R/G342D/ L276W/P277N)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLWNLNEPVHGTKRRSQIQTYLDHHGGPGVQHIALASDDVLGTLREMRARSAMGGFEFLAPPPPNYYDDVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 171 - DNA, 1341 bp, Artificial Sequence
  Description of Artificial Sequence: Synthetic polynucleotide
  The ORF sequence of rice hppd mutant(Oshppd_H141R/N338D/G342D/ K418P/G419F)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggccgttcaacttctcggagctgttcaagtccattgaggagtatgagaaatcccttgaagccaagcaagcccctacagttcaaggatcctag

SEQ ID NO: 172 - protein, 446 aa, Artificial Sequence
  Description of Artificial Sequence: Synthetic polypeptide
  The amino acid sequence of rice HPPD mutant(OsHPPD_H141R/N338D/ G342D/K418P/G419F)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPDYYDDVRRRAGDVLSEEQINECQELGVLVDRDDQGVLLQIFTKPVGDRPTFFLEMIQRIGCMEKDESGQEYQKGGCGGFGPFNFSELFKSIEEYEKSLEAKQAPTVQGS

SEQ ID NO: 173 - DNA, 1341 bp, Artificial Sequence
  Description of Artificial Sequence: Synthetic polynucleotide
  The ORF sequence of rice hppd mutant(Oshppd_H141R/N338D/G342D/ G419F/N420S)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagttcagcttctcggagctgttcaagtccattgaggagtatgagaaatcccttgaagccaagcaagcccctacagttcaaggatcctag

SEQ ID NO: 174 - protein, 446 aa, Artificial Sequence
  Description of Artificial Sequence: Synthetic polypeptide
  The amino acid sequence of rice HPPD mutant(OsHPPD_H141R/N338D/ G342D/G419F/N420S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPDYYDDVRRRAGDVLSEEQINECQELGVLVDRDDQGVLLQIFTKPVGDRPTFFLEMIQRIGCMEKDESGQEYQKGGCGGFGKFSFSELFKSIEEYEKSLEAKQAPTVQGS

SEQ ID NO: 175 - DNA, 1341 bp, Artificial Sequence
  Description of Artificial Sequence: Synthetic polynucleotide
  The ORF sequence of rice hppd mutant(Oshppd_H141R/N338D/G342D/ K418P/G419F/N420S)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggccgttcagcttctcggagctgttcaagtccattgaggagtatgagaaatcccttgaagccaagcaagcccctacagttcaaggatcctag

SEQ ID NO: 176 - protein, 446 aa, Artificial Sequence
  Description of Artificial Sequence: Synthetic polypeptide
  The amino acid sequence of rice HPPD mutant(OsHPPD_H141R/N338D/ G342D/K418P/G419F/N420S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPDYYDDVRRRAGDVLSEEQINECQELGVLVDRDDQGVLLQIFTKPVGDRPTFFLEMIQRIGCMEKDESGQEYQKGGCGGFGPFSFSELFKSIEEYEKSLEAKQAPTVQGS

SEQ ID NO: 177 - DNA, 1341 bp, Artificial Sequence
  Description of Artificial Sequence: Synthetic polynucleotide
  The ORF sequence of rice hppd mutant(Oshppd_H141R/N338D/G342D/ K418P/G419F/N420T)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggccgttcaccttctcggagctgttcaagtccattgaggagtatgagaaatcccttgaagccaagcaagcccctacagttcaaggatcctag

SEQ ID NO: 178 - protein, 446 aa, Artificial Sequence
  Description of Artificial Sequence: Synthetic polypeptide
  The amino acid sequence of rice HPPD mutant(OsHPPD_H141R/N338D/ G342D/K418P/G419F/N420T)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPDYYDDVRRRAGDVLSEEQINECQELGVLVDRDDQGVLLQIFTKPVGDRPTFFLEMIQRIGCMEKDESGQEYQKGGCGGFGPFTFSELFKSIEEYEKSLEAKQAPTVQGS

SEQ ID NO: 179 - DNA, 1341 bp, Artificial Sequence
  Description of Artificial Sequence: Synthetic polynucleotide
  The ORF sequence of rice hppd mutant(Oshppd_H141R/N338D/G342D/ R346C/K418P/G419F/N420S)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacgacgtgcggcggtgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggccgttcagcttctcggagctgttcaagtccattgaggagtatgagaaatcccttgaagccaagcaagcccctacagttcaaggatcctag

SEQ ID NO: 180 - protein, 446 aa, Artificial Sequence
  Description of Artificial Sequence: Synthetic polypeptide
  The amino acid sequence of rice HPPD mutant(OsHPPD_H141R/N338D/ G342D/R346C/K418P/G419F/N420S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPDYYDDVRRCAGDVLSEEQINECQELGVLVDRDDQGVLLQIFTKPVGDRPTFFLEMIQRIGCMEKDESGQEYQKGGCGGFGPFSFSELFKSIEEYEKSLEAKQAPTVQGS

SEQ ID NO: 181 - DNA, 1341 bp, Artificial Sequence
  Description of Artificial Sequence: Synthetic polynucleotide
  The ORF sequence of rice hppd mutant(Oshppd_H141R/N338D/G342D/ R346H/K418P/G419F/N420S)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacgacgtgcggcggcacgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggccgttcagcttctcggagctgttcaagtccattgaggagtatgagaaatcccttgaagccaagcaagcccctacagttcaaggatcctag

SEQ ID NO: 182 - protein, 446 aa, Artificial Sequence
  Description of Artificial Sequence: Synthetic polypeptide
  The amino acid sequence of rice HPPD mutant(OsHPPD_H141R/N338D/ G342D/R346H/K418P/G419F/N420S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPDYYDDVRRHAGDVLSEEQINECQELGVLVDRDDQGVLLQIFTKPVGDRPTFFLEMIQRIGCMEKDESGQEYQKGGCGGFGPFSFSELFKSIEEYEKSLEAKQAPTVQGS

SEQ ID NO: 183 - DNA, 1341 bp, Artificial Sequence
  Description of Artificial Sequence: Synthetic polynucleotide
  The ORF sequence of rice hppd mutant(Oshppd_P277N/P336D/N338D/ G342D)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgaatctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatcccgactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 184 - protein, 446 aa, Artificial Sequence
  Description of Artificial Sequence: Synthetic polypeptide
  The amino acid sequence of rice HPPD mutant(OsHPPD_P277N/P336D/ N338D/G342D)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLNLNEPVHGTKRRSQIQTYLDHHGGPGVQHIALASDDVLGTLREMRARSAMGGFEFLAPPDPDYYDDVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 185 - DNA, 1341 bp, Artificial Sequence
  Description of Artificial Sequence: Synthetic polynucleotide
  The ORF sequence of rice hppd mutant(Oshppd_P277N/N338D/G342D/ R346C)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgaatctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacgacgtgcggcggtgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 186 - protein, 446 aa, Artificial Sequence
  Description of Artificial Sequence: Synthetic polypeptide
  The amino acid sequence of rice HPPD mutant(OsHPPD_P277N/N338D/ G342D/R346C)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLNLNEPVHGTKRRSQIQTYLDHHGGPGVQHIALASDDVLGTLREMRARSAMGGFEFLAPPPPDYYDDVRRCAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 187 - DNA, 1341 bp, Artificial Sequence
  Description of Artificial Sequence: Synthetic polynucleotide
  The ORF sequence of rice hppd mutant(Oshppd_P277N/N338D/K418P/ G419F)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgaatctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacggcgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggccgttcaacttctcggagctgttcaagtccattgaggagtatgagaaatcccttgaagccaagcaagcccctacagttcaaggatcctag

SEQ ID NO: 188 - protein, 446 aa, Artificial Sequence
  Description of Artificial Sequence: Synthetic polypeptide
  The amino acid sequence of rice HPPD mutant(OsHPPD_P277N/N338D/ K418P/G419F)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLNLNEPVHGTKRRSQIQTYLDHHGGPGVQHIALASDDVLGTLREMRARSAMGGFEFLAPPPPDYYDGVRRRAGDVLSEEQINECQELGVLVDRDDQGVLLQIFTKPVGDRPTFFLEMIQRIGCMEKDESGQEYQKGGCGGFGPFNFSELFKSIEEYEKSLEAKQAPTVQGS

SEQ ID NO: 189 - DNA, 1341 bp, Artificial Sequence
  Description of Artificial Sequence: Synthetic polynucleotide
  The ORF sequence of rice hppd mutant(Oshppd_H141R/P277N/N338D/ G342D/K418P/G419F/N420S)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgaatctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggccgttcagcttctcggagctgttcaagtccattgaggagtatgagaaatcccttgaagccaagcaagcccctacagttcaaggatcctag

SEQ ID NO: 190 - protein, 446 aa, Artificial Sequence
  Description of Artificial Sequence: Synthetic polypeptide
  The amino acid sequence of rice HPPD mutant(OsHPPD_H141R/P277N/ N338D/G342D/K418P/G419F/N420S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLNLNEPVHGTKRRSQIQTYLDHHGGPGVQHIALASDDVLGTLREMRARSAMGGFEFLAPPPPDYYDDVRRRAGDVLSEEQINECQELGVLVDRDDQGVLLQIFTKPVGDRPTFFLEMIQRIGCMEKDESGQEYQKGGCGGFGPFSFSELFKSIEEYEKSLEAKQAPTVQGS

SEQ ID NO: 191 - DNA, 1341 bp, Artificial Sequence
  Description of Artificial Sequence: Synthetic polynucleotide
  The ORF sequence of rice hppd mutant(Oshppd_H141R/P277N/P336D/ N338D/G342D/K418P/G419F/N420S)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgaatctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatcccgactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggccgttcagcttctcggagctgttcaagtccattgaggagtatgagaaatcccttgaagccaagcaagcccctacagttcaaggatcctag

SEQ ID NO: 192 - protein, 446 aa, Artificial Sequence
  Description of Artificial Sequence: Synthetic polypeptide
  The amino acid sequence of rice HPPD mutant(OsHPPD_H141R/P277N/ P336D/N338D/G342D/K418P/G419F/N420S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLNLNEPVHGTKRRSQIQTYLDHHGGPGVQHIALASDDVLGTLREMRARSAMGGFEFLAPPDPDYYDDVRRRAGDVLSEEQINECQELGVLVDRDDQGVLLQIFTKPVGDRPTFFLEMIQRIGCMEKDESGQEYQKGGCGGFGPFSFSELFKSIEEYEKSLEAKQAPTVQGS

SEQ ID NO: 193 - DNA, 1341 bp, Artificial Sequence
  Description of Artificial Sequence: Synthetic polynucleotide
  The ORF sequence of rice hppd mutant(Oshppd_H141R/G336D/G342D/ K418P/G419F/N420S)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcgcgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatcccaactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggccgttcagcttctcggagctgttcaagtccattgaggagtatgagaaatcccttgaagccaagcaagcccctacagttcaaggatcctag

SEQ ID NO: 194 - protein, 446 aa, Artificial Sequence
  Description of Artificial Sequence: Synthetic polypeptide
  The amino acid sequence of rice HPPD mutant(OsHPPD_H141R/G336D/ G342D/K418P/G419F/N420S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVRAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPNYYDDVRRRAGDVLSEEQINECQELGVLVDRDDQGVLLQIFTKPVGDRPTFFLEMIQRIGCMEKDESGQEYQKGGCGGFGPFSFSELFKSIEEYEKSLEAKQAPTVQGS

SEQ ID NO: 195 - DNA, 1341 bp, Artificial Sequence
  Description of Artificial Sequence: Synthetic polynucleotide
  The ORF sequence of rice hppd mutant(Oshppd_P336D/N338D/G342D)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatcccgactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 196 - protein, 446 aa, Artificial Sequence
  Description of Artificial Sequence: Synthetic polypeptide
  The amino acid sequence of rice HPPD mutant(OsHPPD_P336D/N338D/ G342D)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPDYYDDVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 197 - DNA, 1341 bp, Artificial Sequence
  Description of Artificial Sequence: Synthetic polynucleotide
  The ORF sequence of rice hppd mutant(Oshppd_P336D/N338S/G342D)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatcccagctactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 198 - protein, 446 aa, Artificial Sequence
  Description of Artificial Sequence: Synthetic polypeptide
  The amino acid sequence of rice HPPD mutant(OsHPPD_P336D/N338S/ G342D)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPSYYDDVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 199 - DNA, 1341 bp, Artificial Sequence
  Description of Artificial Sequence: Synthetic polynucleotide
  The ORF sequence of rice hppd mutant(Oshppd_P336D/N338Y/G342D)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatccctactactacgacgacgtgcggcggcgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 200 - protein, 446 aa, Artificial Sequence
  Description of Artificial Sequence: Synthetic polypeptide
  The amino acid sequence of rice HPPD mutant(OsHPPD_P336D/N338Y/ G342D)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPYYYDDVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 201 - DNA, 1341 bp, Artificial Sequence
  Description of Artificial Sequence: Synthetic polynucleotide
  The ORF sequence of rice hppd mutant(Oshppd_N338D/G342D/R346C)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacgacgtgcggcggtgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 202 - protein, 446 aa, Artificial Sequence
  Description of Artificial Sequence: Synthetic polypeptide
  The amino acid sequence of rice HPPD mutant(OsHPPD_N338D/G342D/ R346C)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPDYYDDVRRCAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 203 - DNA, 1341 bp, Artificial Sequence
  Description of Artificial Sequence: Synthetic polynucleotide
  The ORF sequence of rice hppd mutant(Oshppd_N338D/G342D/R346H)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacgacgtgcggcggcacgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 204 - protein, 446 aa, Artificial Sequence
  Description of Artificial Sequence: Synthetic polypeptide
  The amino acid sequence of rice HPPD mutant(OsHPPD_N338D/G342D/ R346H)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPDYYDDVRRHAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 205 - DNA, 1341 bp, Artificial Sequence
  Description of Artificial Sequence: Synthetic polynucleotide
  The ORF sequence of rice hppd mutant(Oshppd_N338D/G342D/R346S)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccgactactacgacgacgtgcggcggagcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 206 - protein, 446 aa, Artificial Sequence
  Description of Artificial Sequence: Synthetic polypeptide
  The amino acid sequence of rice HPPD mutant(OsHPPD_N338D/G342D/ R346S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPDYYDDVRRSAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 207 - DNA, 1341 bp, Artificial Sequence
  Description of Artificial Sequence: Synthetic polynucleotide
  The ORF sequence of rice hppd mutant(Oshppd_N338S/G342D/R346C)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccagctactacgacgacgtgcggcggtgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 208 - protein, 446 aa, Artificial Sequence
  Description of Artificial Sequence: Synthetic polypeptide
  The amino acid sequence of rice HPPD mutant(OsHPPD_N338S/G342D/ R346C)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPSYYDDVRRCAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 209 - DNA, 1341 bp, Artificial Sequence
  Description of Artificial Sequence: Synthetic polynucleotide
  The ORF sequence of rice hppd mutant(Oshppd_N338S/G342D/R346H)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccagctactacgacgacgtgcggcggcacgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 210 - protein, 446 aa, Artificial Sequence
  Description of Artificial Sequence: Synthetic polypeptide
  The amino acid sequence of rice HPPD mutant(OsHPPD_N338S/G342D/ R346H)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPSYYDDVRRHAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 211 - DNA, 1341 bp, Artificial Sequence
  Description of Artificial Sequence: Synthetic polynucleotide
  The ORF sequence of rice hppd mutant(Oshppd_N338S/G342D/R346S)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgcccagctactacgacgacgtgcggcggagcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 212 - protein, 446 aa, Artificial Sequence
  Description of Artificial Sequence: Synthetic polypeptide
  The amino acid sequence of rice HPPD mutant(OsHPPD_N338S/G342D/ R346S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPSYYDDVRRSAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 213 - DNA, 1341 bp, Artificial Sequence
  Description of Artificial Sequence: Synthetic polynucleotide
  The ORF sequence of rice hppd mutant(Oshppd_N338Y/G342D/R346C)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgccctactactacgacgacgtgcggcggtgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 214 - protein, 446 aa, Artificial Sequence
  Description of Artificial Sequence: Synthetic polypeptide
  The amino acid sequence of rice HPPD mutant(OsHPPD_N338Y/G342D/ R346C)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPYYYDDVRRCAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 215 - DNA, 1341 bp, Artificial Sequence
  Description of Artificial Sequence: Synthetic polynucleotide
  The ORF sequence of rice hppd mutant(Oshppd_N338Y/G342D/R346H)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgccctactactacgacgacgtgcggcggcacgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 216 - protein, 446 aa, Artificial Sequence
  Description of Artificial Sequence: Synthetic polypeptide
  The amino acid sequence of rice HPPD mutant(OsHPPD_N338Y/G342D/ R346H)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPYYYDDVRRHAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 217 - DNA, 1341 bp, Artificial Sequence
  Description of Artificial Sequence: Synthetic polynucleotide
  The ORF sequence of rice hppd mutant(Oshppd_N338Y/G342D/R346S)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccgccgccctactactacgacgacgtgcggcggagcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 218 - protein, 446 aa, Artificial Sequence
  Description of Artificial Sequence: Synthetic polypeptide
  The amino acid sequence of rice HPPD mutant(OsHPPD_N338Y/G342D/ R346S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPYYYDDVRRSAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 219 - DNA, 1341 bp, Artificial Sequence
  Description of Artificial Sequence: Synthetic polynucleotide
  The ORF sequence of rice hppd mutant(Oshppd_P336D/G342D/R346H)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatcccaactactacgacgacgtgcggcggcacgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 220 - protein, 446 aa, Artificial Sequence
  Description of Artificial Sequence: Synthetic polypeptide
  The amino acid sequence of rice HPPD mutant(OsHPPD_P336D/G342D/ R346H)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPNYYDDVRRHAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 221 - DNA, 1341 bp, Artificial Sequence
  Description of Artificial Sequence: Synthetic polynucleotide
  The ORF sequence of rice hppd mutant(Oshppd_P336D/G342D/R346C)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatcccaactactacgacgacgtgcggcggtgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 222 - protein, 446 aa, Artificial Sequence
  Description of Artificial Sequence: Synthetic polypeptide
  The amino acid sequence of rice HPPD mutant(OsHPPD_P336D/G342D/ R346C)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPNYYDDVRRCAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 223 - DNA, 1341 bp, Artificial Sequence
  Description of Artificial Sequence: Synthetic polynucleotide
  The ORF sequence of rice hppd mutant(Oshppd_P336D/G342D/R346S)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatcccaactactacgacgacgtgcggcggagcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 224 - protein, 446 aa, Artificial Sequence
  Description of Artificial Sequence: Synthetic polypeptide
  The amino acid sequence of rice HPPD mutant(OsHPPD_P336D/G342D/ R346S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPNYYDDVRRSAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 225 - DNA, 1341 bp, Artificial Sequence
  Description of Artificial Sequence: Synthetic polynucleotide
  The ORF sequence of rice hppd mutant(Oshppd_P336D/N338D/R346C)
atgcctcccactcccacccccaccgccaccaccggcgccgtctcggccgctgcggcggcgggggagaacgcggggttccgcctcgtcgggcaccgccgcttcgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggcggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcggccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatcccgactactacgacggcgtgcggcggtgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 226 - protein, 446 aa, Artificial Sequence
  Description of Artificial Sequence: Synthetic polypeptide
  The amino acid sequence of rice HPPD mutant(OsHPPD_P336D/N338D/ R346C)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPDYYDGVRRCAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 227 - DNA, 1341 bp, Artificial Sequence
  Description of Artificial Sequence: Synthetic polynucleotide
  The ORF sequence of rice hppd mutant(Oshppd_P336D/N338D/R346H)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatcccgactactacgacggcgtgcggcggcacgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 228 - protein, 446 aa, Artificial Sequence
  Description of Artificial Sequence: Synthetic polypeptide
  The amino acid sequence of rice HPPD mutant(OsHPPD_P336D/N338D/ R346H)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPDYYDGVRRHAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 229 - DNA, 1341 bp, Artificial Sequence
  Description of Artificial Sequence: Synthetic polynucleotide
  The ORF sequence of rice hppd mutant(Oshppd_P336D/N338D/R346S)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatcccgactactacgacggcgtgcggcggagcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 230 - protein, 446 aa, Artificial Sequence
  Description of Artificial Sequence: Synthetic polypeptide
  The amino acid sequence of rice HPPD mutant(OsHPPD_P336D/N338D/ R346S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPDYYDGVRRSAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 231 - DNA, 1341 bp, Artificial Sequence
  Description of Artificial Sequence: Synthetic polynucleotide
  The ORF sequence of rice hppd mutant(Oshppd_P336D/N338S/R346C)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatcccagctactacgacggcgtgcggcggtgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 232 - protein, 446 aa, Artificial Sequence
  Description of Artificial Sequence: Synthetic polypeptide
  The amino acid sequence of rice HPPD mutant(OsHPPD_P336D/N338S/ R346C)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPSYYDGVRRCAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 233 - DNA, 1341 bp, Artificial Sequence
  Description of Artificial Sequence: Synthetic polynucleotide
  The ORF sequence of rice hppd mutant(Oshppd_P336D/N338S/R346H)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatcccagctactacgacggcgtgcggcggcacgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 234 - protein, 446 aa, Artificial Sequence
  Description of Artificial Sequence: Synthetic polypeptide
  The amino acid sequence of rice HPPD mutant(OsHPPD_P336D/N338S/ R346H)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPSYYDGVRRHAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 235 - DNA, 1341 bp, Artificial Sequence
  Description of Artificial Sequence: Synthetic polynucleotide
  The ORF sequence of rice hppd mutant(Oshppd_P336D/N338S/R346S)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatcccagctactacgacggcgtgcggcggagcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 236 - protein, 446 aa, Artificial Sequence
  Description of Artificial Sequence: Synthetic polypeptide
  The amino acid sequence of rice HPPD mutant(OsHPPD_P336D/N338S/ R346S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPSYYDGVRRSAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 237 - DNA, 1341 bp, Artificial Sequence
  Description of Artificial Sequence: Synthetic polynucleotide
  The ORF sequence of rice hppd mutant(Oshppd_P336D/N338Y/R346C)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatccctactactacgacggcgtgcggcggtgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 238 - protein, 446 aa, Artificial Sequence
  Description of Artificial Sequence: Synthetic polypeptide
  The amino acid sequence of rice HPPD mutant(OsHPPD_P336D/N338Y/ R346C)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPYYYDGVRRCAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 239 - DNA, 1341 bp, Artificial Sequence
  Description of Artificial Sequence: Synthetic polynucleotide
  The ORF sequence of rice hppd mutant(Oshppd_P336D/N338Y/R346H)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatccctactactacgacggcgtgcggcggcacgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 240 - protein, 446 aa, Artificial Sequence
  Description of Artificial Sequence: Synthetic polypeptide
  The amino acid sequence of rice HPPD mutant(OsHPPD_P336D/N338Y/ R346H)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPYYYDGVRRHAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 241 - DNA, 1341 bp, Artificial Sequence
  Description of Artificial Sequence: Synthetic polynucleotide
  The ORF sequence of rice hppd mutant(Oshppd_P336D/N338Y/R346S)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatccctactactacgacggcgtgcggcggagcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 242 - protein, 446 aa, Artificial Sequence
  Description of Artificial Sequence: Synthetic polypeptide
  The amino acid sequence of rice HPPD mutant(OsHPPD_P336D/N338Y/ R346S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPYYYDGVRRSAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 243 - DNA, 1341 bp, Artificial Sequence
  Description of Artificial Sequence: Synthetic polynucleotide
  The ORF sequence of rice hppd mutant(Oshppd_P336D/N338D/G342D/ R346C)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatcccgactactacgacgacgtgcggcggtgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 244 - protein, 446 aa, Artificial Sequence
  Description of Artificial Sequence: Synthetic polypeptide
  The amino acid sequence of rice HPPD mutant(OsHPPD_P336D/N338D/ G342D/R346C)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPDYYDDVRRCAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 245 - DNA, 1341 bp, Artificial Sequence
  Description of Artificial Sequence: Synthetic polynucleotide
  The ORF sequence of rice hppd mutant(Oshppd_P336D/N338D/G342D/ R346H)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatcccgactactacgacgacgtgcggcggcacgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 246 - protein, 446 aa, Artificial Sequence
  Description of Artificial Sequence: Synthetic polypeptide
  The amino acid sequence of rice HPPD mutant(OsHPPD_P336D/N338D/ G342D/R346H)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPDYYDDVRRHAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 247 - DNA, 1341 bp, Artificial Sequence
  Description of Artificial Sequence: Synthetic polynucleotide
  The ORF sequence of rice hppd mutant(Oshppd_P336D/N338D/G342D/ R346S)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatcccgactactacgacgacgtgcggcggagcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 248 - protein, 446 aa, Artificial Sequence
  Description of Artificial Sequence: Synthetic polypeptide
  The amino acid sequence of rice HPPD mutant(OsHPPD_P336D/N338D/ G342D/R346S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPDYYDDVRRSAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 249 - DNA, 1341 bp, Artificial Sequence
  Description of Artificial Sequence: Synthetic polynucleotide
  The ORF sequence of rice hppd mutant(Oshppd_P336D/N338S/G342D/ R346C)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatcccagctactacgacgacgtgcggcggtgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 250 - protein, 446 aa, Artificial Sequence
  Description of Artificial Sequence: Synthetic polypeptide
  The amino acid sequence of rice HPPD mutant(OsHPPD_P336D/N338S/ G342D/R346C)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPSYYDDVRRCAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 251 - DNA, 1341 bp, Artificial Sequence
  Description of Artificial Sequence: Synthetic polynucleotide
  The ORF sequence of rice hppd mutant(Oshppd_P336D/N338S/G342D/ R346H)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatcccagctactacgacgacgtgcggcggcacgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 252 - protein, 446 aa, Artificial Sequence
  Description of Artificial Sequence: Synthetic polypeptide
  The amino acid sequence of rice HPPD mutant(OsHPPD_P336D/N338S/ G342D/R346H)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPSYYDDVRRHAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 253 - DNA, 1341 bp, Artificial Sequence
  Description of Artificial Sequence: Synthetic polynucleotide
  The ORF sequence of rice hppd mutant(Oshppd_P336D/N338S/G342D/ R346S)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatcccagctactacgacgacgtgcggcggagcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 254 - protein, 446 aa, Artificial Sequence
  Description of Artificial Sequence: Synthetic polypeptide
  The amino acid sequence of rice HPPD mutant(OsHPPD_P336D/N338S/ G342D/R346S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPSYYDDVRRSAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 255 - DNA, 1341 bp, Artificial Sequence
  Description of Artificial Sequence: Synthetic polynucleotide
  The ORF sequence of rice hppd mutant(Oshppd_P336D/N338Y/G342D/ R346C)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatccctactactacgacgacgtgcggcggtgcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 256 - protein, 446 aa, Artificial Sequence
  Description of Artificial Sequence: Synthetic polypeptide
  The amino acid sequence of rice HPPD mutant(OsHPPD_P336D/N338Y/ G342D/R346C)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPYYYDDVRRCAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 257 - DNA, 1341 bp, Artificial Sequence
  Description of Artificial Sequence: Synthetic polynucleotide
  The ORF sequence of rice hppd mutant(Oshppd_P336D/N338Y/G342D/ R346H)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatccctactactacgacgacgtgcggcggcacgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 258 - protein, 446 aa, Artificial Sequence
  Description of Artificial Sequence: Synthetic polypeptide
  The amino acid sequence of rice HPPD mutant(OsHPPD_P336D/N338Y/ G342D/R346H)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPYYYDDVRRHAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 259 - DNA, 1341 bp, Artificial Sequence
  Description of Artificial Sequence: Synthetic polynucleotide
  The ORF sequence of rice hppd mutant(Oshppd_P336D/N338Y/G342D/ R346S)
atgcctcccactcccacccccaccgccaccaccggcgccgtctcggccgctgcggcggcgggggagaacgcggggttccgcctcgtcgggcaccgccgctttgtccgcgccaacccgcggagcgaccggttccaggcgctcgcgttccaccacgtcgagctctggtgcgccgacgccgcgtccgccgcgggccggttcgccttcgccctgggcgcgccgctcgccgccaggtccgacctctccacggggaactccgcgcacgcctccctcctcctccgctccgcctccgtcgcgttcctcttcaccgccccctacggtggcgaccacggcgtcggcgcggacgcggccaccaccgcctccatcccttccttctccccaggcgccgcgcggaggttcgccgcggaccacggcctcgcggtgcacgccgtggcgctgcgcgtcgccgacgcggccgacgccttccgcgccagcgtcgcagccggtgcgcgcccggcgttccagcccgccgacctcggcggtggcttcggcctcgcggaggtggagctctacggcgacgtcgtgctccgcttcgtcagccacccggacggcgccgacgcgcccttcctcccgggtttcgagggcgtcagcaacccgggcgccgtggactacggcctccgccggttcgaccacgtcgtcggcaacgtgccggagctcgctccggtagccgcgtacatctccgggttcaccgggttccacgagttcgccgagttcaccgccgaggacgtgggcaccgccgagagcggcctcaactcggtggtgctcgccaacaacgcggagaccgtgctgctgccgctcaacgagccggtgcacggcaccaagcggcggagccagatacagacgtacctggaccaccacggcggcccgggggtgcagcacatcgcgctggccagcgacgacgtgctcgggacgctgagggagatgcgggcgcgctccgccatgggcggcttcgagttcttggcgccgccggatccctactactacgacgacgtgcggcggagcgccggggacgtgctctcggaggagcagatcaacgagtgccaggagctcggggtgctcgtggacagggatgaccagggggtgttgctccagatcttcaccaagccagtaggagacaggccaacctttttcttggagatgatacaaaggattgggtgcatggagaaggatgagagtgggcaggagtaccagaagggcggctgcggcgggtttgggaagggcaacttctcggagctgttcaagtccattgaggagtatgagaaatcccttgaagccaagcaagcccctacagttcaaggatcctag

SEQ ID NO: 260 - protein, 446 aa, Artificial Sequence
  Description of Artificial Sequence: Synthetic polypeptide
  The amino acid sequence of rice HPPD mutant(OsHPPD_P336D/N338Y/ G342D/R346S)
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPDPYYYDDVRRSAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

What is claimed is:

1. A mutant p-hydroxyphenylpyruvate dioxygenase (HPPD) protein, comprising the amino acid sequence of SEQ ID NO: 2 with the exception of substitution set forth in R93S, A103S, H141R, H141K, H141T, A165V, V191I, R220K, G226H, L276W, N338D, N338S, N338Y, G342D, D370N, I377C, P386T, M392L, E403G, K410I, N420S, N420T, E430G or Y431 L, or a combination thereof.

2. The mutant p-hydroxphenylpyruvate dioxygenase (HPPD) protein according to claim 1, wherein the mutant p-hydroxyphenylpyruvate dioxygenase protein comprises the amino acid sequence as set forth in SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 32, SEQ ID NO: 34, SEQ ID NO: 36, SEQ ID NO: 44, SEQ ID NO: 46, SEQ ID NO: 48, SEQ ID NO: 60, SEQ ID NO; 62, SEQ ID NO: 66, SEQ ID NO: 76, SEQ ID NO: 78, SEQ ID NO: 80, SEQ ID NO: 82 or SEQ ID NO: 84.

3. A mutant p-hydroxyphenylpyruvate dioxygenase (HPPD) protein comprising the amino acid sequence of SEQ ID NO: 2 with the exception of substitution set forth in: H141R/G342D, H141R/D370N, G342D/D370N, H141R/N338D, N338D/G342D, G342D/R346H, H141R/N420S, H141R/G342D/D370N, H141R/N338D/N420S, H141R/N338S/N420S, N338D/G342D/R346H, N338S/G342D/R346H, N338Y/G342D/R346H, H141R/N338D/G342D, H141R/G342D/P386T, H141R/G342D/R346H, H141R/G342D/N420S, H141R/G342D/L276W, H141R/G342D/I377C, H141R/G342D/M392L, H141R/N338S/G342D, H141R/N338Y/G342D, H141R/N338D/G342D/P386T, or H141R/N338D/G342D/R346H.

4. The mutant p-hydroxyphenylpyruvate dioxygenase (HPPD) protein according to claim 1, wherein the mutant p-hydroxyphenylpyruvate dioxygenase protein filer comprises the amino acid sequence as set forth in SEQ ID NO: 24, SEQ ID NO: 26, SEQ ID NO: 28, SEQ ID NO: 30, SEQ ID NO: 86, SEQ ID NO: 90, SEQ ID NO: 98, SEQ ID NO: 100, SEQ ID NO: 108, SEQ ID NO: 114, SEQ ID NO: 122, SEQ ID NO: 124, SEQ ID NO: 130, SEQ ID NO: 136, SEQ ID NO: 138, SEQ ID NO: 142, SEQ ID NO: 144, SEQ ID NO: 154, SEQ ID NO: 156, SEQ ID NO: 162, SEQ ID NO: 166, SEQ ID NO: 204, SEQ ID NO: 210, or SEQ ID NO: 216.

5. A fusion protein, comprising the mutant HPPD protein according to claim 1 and an additional component that is fused thereto.

6. The fusion protein comprising the mutant HPPD protein according to claim 5, wherein the additional component is a tag peptide or a guiding peptide for plastid.

* * * * *